United States Patent 11,752,178 (METHODS FOR THE ISOLATION OF MICROBES WITH ENHANCED PERSISTANCE AND COMPOSITIONS WITH SUCH MICROBES) - sequence listing, part 4

SEQ ID NO: 74 - DNA, 465955 bp, Bifidobacterium pseudocatenulatum
  misc_feature (174168)..(174267): n is a, c, g, or t
gcgggcaaccagtcgaactacgccgccgccctggcgatcacgatggccgtgatcacgatggcgatcgcgtacgcggtgcagctcaacagcatgaaggagcagatgaagtgacgccttggggcgtgcgtcatccgcatgggacatggatttttcaaggagcgtaacaatcatgagcgatgctgcgatgtcgacggggtatatgactccccaagggcttaaagagcaggaacgggccgcgaagaaggccgagagggcgcgcttgaagcgcgtggaaatggatgagaaggcggagcgcaaacgcgcggcgaagtccggtttcgcgaacgtgtcgaacccgaggcgcagcaagctgctgaccttggtatgcgcgatcttcgcggtgtactgcctgttcccgttcgtgtacctgctggtcaacgccaccaagacgcaggccgacttcacttcgacgttcggcctgggtttcggccacacgttcgccctgtgggacaacatcgtgaccgtgttcacgtaccaggacggcatcttcgggcgctggctgctcaacacgctcctgtacgtggtcgtgggcgcgggcggcgcgacgctgctggccatcatgggcggctacgcgctggcgaagttccgtttcccgggccgcaaggccgtgttcgcggtcatcatcggcgcgatcagcgtgccgggcatcgcgttggcggtcccgcagttcctgctgttcgccaagctcagcctgacgaacacgccgtgggccatgatcattccatcgttgatcagcccgttcggcttgtatctgatgtggatcttctccgagcaggcggttccgacggaattgctcgaggccgcacgagtcgatggggcttcggagttccgcacgttcttccaggtgtccctgccgctgttggctccgggcatcgtcacgacggccctgttcacgatcgtggcgacgtggaacaactacttcctgccgttgatcatgctgaaggattcgaactggtatccgttgacgatcggtttgaaccagtggaaggaccaggcgagcaccgctggcggccaggcgatccagaacctggtgatcacgggctcgttgatcacgatcatcccgctggtcatcgcgttcctgtgcctgcagaagtactggcagtccggcctctccgcaggcgcggtcaaggaatgaatttgttaggatagttgacgaaaaacaaaggagtggatatgactcaacgtagatcctatcgttggccgcagccgttggctgggcagcaagcccgcatctggtacggcggggactacaatcccgaccagtggccggaagaggtgtgggacgatgacgttcgtctgatgaagaaggctggcgtgaacctcgtgtccgtcggcatcttctcatgggcgaagatcgagacgagcgaaggcgtgtacgatttcgactggctcgaccgcatcatcgacaagctgggcgaggccggcgtcgccgtggatttggcgtccgccaccgcttcgccgccgatgtggctcacccaggcgcatcccgaggtgctgtggaaggactaccgcggcgacgtgtgccagcctggcgcacgccagcattggaggcccacgagcccggtgttccgcgagtacgcgctgaagctgtgccgtgcgatggccgagcattacaagggcaatccgtacgtggtcgcgtggcatgtgagcaacgagtacggctgccacaaccgtttcgactattccgaggacgccgaacatgcgttccagcagtggtgcgaggaacgctacggcaccatcgacgcggtgaacgacgcgtgggggaccgcgttctgggcacagcgcatgaacgacttcagtgagatcgtgcctccgcgcttcatcggcgacggcaacttcatgaacccgggcaagctgctcgacttcaagcggttcagctcggacgcgttgaaggcgttctacatcgccgagcgcgacacgcttgccgagatcacgccggatctgcccctgaccacgaacttcatggtgtccgcgtccggttcggtgttggactacgacgattggggcgacgaggtcgatttcgtgtcgaacgaccattacttcattccgggcgaggcccacttggacgagctcgcgttctccgcgagcctggtcgacggcatcgcacgcaaggatccgtggttcctgatggagcattccaccagcgcggtcaactggcgtgagatcaactaccgcaaggagcccggccagctggtgcgcgactctttggctcatgtggccatgggtgcggacgcggtgtgctacttccagtggaggcagtccaaggcaggcgcggagaagttccattccgcgatggtgccccacgcgggcgaggattccgccgtgttccgcgacgtgtgcgagctgggcgccgatctgaacaaactgtccgacgagggcattctgggatcgaggctcgcgaagtcccgtgtggccgtggtattcgactacgagtccgaatgggccaccgaacacaccgccacgccgacccagcacgtgcatcacgtggacgagccattggcgtggttccgcgctttggccgatcagggtgtgaccgccgacgtggtgccggtgcgcggcgcctgggatgactatgagatggtcgtattgccgagtgtatacctgctttccgaggaaacgacccgcagggtgcgcgattacgttgtgggtggcggccgcctggtcgtgacctactacacgggcatttcggatgagaaggaccacgtgtggctcggcggctatccgggatcgatccgtgacgtggtcggcgtgcgtgtggaggaattcatgcccatgggcgacgatttcccaggcgtgccggattgtctcggtctgtcgaacggcgcggtcgcgcacgatatcgccgacgtgatcggttcggtcgacgggacggccaccgtgctggaaacgttcaaggacgatccgtggaccggcatggacggcgctccggcgatcgtcgcgcacacattcggcgaaggccgtagcgtgtacgtgggcgcgcgcctcgggcgggacggcatcgcgttgagcctgccggaaatccttgattcgctcggcatggccgaagcgggcggaaacgacggccgagtgctgcgcgtcgaacgtgagggcgcggacggttcgaggttcgtgttctcgttcaaccgcacgcatgagacggtccgggttccggtggaaggcgaagtcgtggtctcctcgttcgctgaagtgagtggcgaaaccatttcgatcaaaccaaacggcgtgatcgtcactaagcagtaagcggacagcaagcaaataatcgcaacattatgggtgtcggcaggttgatgattgtcaatctgccgacacccatttaatttatattcgaataaaaactaggcgtggaattccactgcagcccaactgattgctggcaaagtgcagtgaactgatccattgtcgattgttgcatgaagctcttggggtgtcactgcggttgggtcgtctgcggaattacgctgatatggattgtcgtcatgcagaataatggccttgtctatatggaagtcggatatgtcgaaatacggcagttgagacagagaagctgtaaccttatgtgcgtcggatgcgtcgcgattcaccataagcagaagaccggaatgattcgtttcgtcccaagtgattactgaatcaagggcattgaccaagccgaaagattcagtctctacgttgggagagtcgatgactggactgtaggcaatgccatgggcgtgttgtgcggcttcggcaaacggatagaagacagtttgacgccatgcgggaccgttcttttcggccatgattggcgcaattacattgaccaactgcgcgcgcgaggcagaacgcactcggtcgcagtgcttaagcagagtgatcatcagcgacccttctaccactgcatcggctgcattgtagatatcttcgagcagacgcggtgctttcggccatgactcatgatgaagatccttgcctgattgggctttccattcagcttcctgctgattccagacgtcggaataccagacgccccactcatcaaatgacagtgctatatcatgatcgcctgtgtgggcatttttggcttcgtctgcacatgccgccacggtggagatgaacgtttgcatgtcttgtgaacttgccagataatcttgcaacgattttgctccacgttcgtagtagtaggcatggcaggagacgaaatcgagattgtcgtatgctttggtaagcacgctgcgttcccaggatccaaacgttggcatatgggcgctggaggagccgcaggccacgagttccaagcctgattccgcgagtttcatggcgtgtgcgactcggtccacggctgcggcatactcgtcagggctcatatgtcccacctgccaaaggccatccatttcattgccgatgcaccacattttgatgtccattggttcggtgattccgttacgtacgcggcgatcggcaagctcggtgccgggcgctccgttgacgtattccaactcttccagtgcggccttcaatcctcgggtgcccatattgacggcaagcatgatttcggtaccggtcttcttgctccatcggtagaaatcgtcgataccgacttcattggtttcggtgctgtgccatgcgagatctcgtcgtattgggcgttgaccccgtggccctgtgccatcctcccaattgtaggcagagacgaaattgccgccggggtaacgcacgcaggtcacaccaagttctttgactagattgatgacgtcttggcggaatccgttttcgtcggctgtggggtgacttggctcataaatgcctccgtagacacaacgtccaagatgttctacaaatgatccgaaaatgcggggtggtatatcggcaattgcgctgtttttttgcactgtgattgtgctggttccggaagtcatgccgttcctttcgatgagtggtctgatgaaatgtccgcgttgcgcgagcttcgacggatatgcatcgtctagtatgcaatcatatcgtgtttgcgtagctaaacaaaatatgctaggtaactaaagaaatactggaaaatcaacgatttgcctatttgtttgcgtaaacataacttttgtgttatcctcatgattgtcggaagggtcaatgaatgattcatagccgataatgttggtcgatgtaggaggtcggccatatttaaaggaaggaagaacgatgaagttcactgcatccaagaaaataatcgctctggttgctgctgctgcgatgctgactggtgtcgcagcctgcgggagttcctcgaattcgagttcttcgggggtgacagagggtggtaagactgaaattacggtatggtcttgggattccactttgccgcgtaccgtgaaggattttgaaaaggccaatccggacatcactgttaaggtgaccaatgccggcacgaacagcaccgaatacacggctttgaacaatgcgctttctgcaggtaaaggtgcgccagatttggtgcagattgagtattatgcacttcccgaatatcaggttcgtggagagattgaagacctgagtcagtttggtgcggacaagttctcggatttctatacgccgggcacgtgggcttctgtgaaacttaatggcggtgtgtatgcactgccgatggattccggaccgatggcatggttctataacaaggatgtgtttgataaggccggggttgatccgactcgggtgaggacgtgggatgagttctacgatgctgccaagaaggttcgcgcaacagggtcctacattacgtccgattctggtgatgctggcttcttcgattccatgacatggctggcgggtgcgacgccgttctccactggttccgatggacagtccgtcaccatcaacctcagcaatgattccaaggtcaagacttttgttgatttctggcagaagatgattgctgatgatcttattgataccaagaccgcaggctggagtgatgattggaacaagagtttgaatgacggctctatcgcttcgctgctgaccggtgcttggatgccgtacaacttgctttccggtgctcctgacggtgaggggaagtggcgtgttgctcagatgccgactccggatggatctgaaaccaattccgagaacggtggttcttcgcttgcgatggtcaagacggatgacaaggccaaggccgaagctgcatacaagttcgctgaatatgcgtgccacaatgccgaaggcatcaagactcgcgtcgatggcggcgcattccctgccgataacgacactctcgcttctgatgacttcctgaacatgacctctctgactgattccgatggcaatgcgcacgaatacttcggtggtcagaagttcaatgaggagctcgccaaggctgcggccaatgtttcgactggctacaagttcctgccgttcgaggtttatgcgcgtggcgtatatagcgatgatgccggtggtgcatataccgacaagtctgtcacccttgctgaaggtgttcaggcttgggaaaagaatatcaaggattatgcatctcagcagggctacaccgtgaagtagctgcatgattccatagtggaatcggtaaatatgagcgtctgtggattgagggattgtcaatcggcggacgcttttttgagctatcagtggattgcgtagctgaatcgaagagattggaggattgtacgctggctttcgggtgactgacgtacactcaaatgcgtatgcctgtacgcacgttctcgtgtgggaacaccaaatgggaggaatcggcttgaaactggtgaaacgaatcatcgccatctgctgtgcggccattatggcagtcagcgcggccgcttgcggagccaacgtcgattcccgcaccgaaatcaccgtgtggtcgtgggagccgagcatgaagcaagtcatcgccggtttcgaaaaggaaaatcccgacatccacgttatttggaagaacacaagcggctatgacaatctcaacaacgccattcaagacggctacggcattcccgacgtggtgcaattggaatactatgcattgcgccagtacgcggtaagcagccagctgatggcaatcaccgggcgcacgaaagactacggcgatttctacacgcccggcacatgggcttcggtgcagctgaacggccgcgtgtacggcctgcccatggattccggcccaatggcgttcttctacaacaaaagcgtgttcgaccaggtcggcgttgacgtgtccaaaattcgcacgtgggacgactattacgaggctgccaaaaagctcaaggagatcggcgtgtacatcgcggccgattctggagacgccagcttctacgacacgatgatctggcttgccggaggacgccccttctccacctccaacgacggcaaaaacgtgaccatcaacctcaccggcgatgagggtacgagaaccttcaccgaattctggcagaaaatgatcaacgaaggattggtggacacgagtctgaccgcatggtccgatggatggaaggaagccgtaggagaggggaagatcgcctccatgttctccggcgcatggttgccgtcgctacttatgtcgaaccttcctggaactgcgggattatggcgtgtggcacagatgccgacaccagatggcagcgccaccacgtcggaaaacggcggatccgcgctggccgtgctacaacgctctcgcaaacccgaagcgtcatatcgtttcattgaatacgcatgccataaagcggaaggcatcaaagcccgcgtggatggcggcgcattccccgccgacaacaacacgttgtctgatccggaattcctgcacaaaaccaccgtgaccgacgagcgtggcattgaaataccgtatttcggcggtcaggaatataatcgcgtgctttccgaagctgcggaaaacgtttcgaccggctaccagtatctgccattcgaagtgtatgcgcgaagtgacttccgctccaccgtgggcaaagcctacaaatggtcgagtctcttgtgcaaggagcaggaccggttgaacatcatcgcggccggcggcaaagtgtccgacaaatccgccatcggtgacgcgttgaaggaaaccgattccgcagatcgacttacattgaaaagcggcatcgcgctttggcagaaggatctgaaggaatatggaaccaatcagggctttactattcaataaatattaattatttgcaaaaatacaaaaataatgatggctgtcttgtgttcgattgaaagcaagacagccatacattattatgtaatgagattacatatatctaaatataagattttctatcgtacgttacgctcgtaaatatgcagcatgcctttgaaaatcagatccggatcgtaaatatcgatcatatcggtatcatcggcgaatactcggcttaaaccacccgtcgcaaccacgcggaattcttcgtcgatttcgcgatggaattgtgtgattgtacgttcgatgcctccgaggaagttgtagtacaagccggcctgcatggctggtttggtgcttttcgccagaattgatgcggggcgggtgatttccacttccggcaactgggccgtggcctcccacaaggcggtcgctcccgtgcgaatgccggtggtgatcagtccgcaaatcactgaagcgtcggctgttacgtaattgaatgtggtggccgtgccgaaatccgccaccagaatcggaccgccatactcgtagtaggctccagcacagtcggcgatgcagtcggcacccatgttctgcggattgtccatacgaatgttaatgccggttttgacgcccggtccaatgatcatcggatcgatattgaggaatttcacaatgctggcgcggaacgaatgcatgaccttcggcaccaccgatgagatgatcacatcgtccacatcgcccggtgtgtagccactcaactgcaggaattgcgtgatcatcaggccatattcgtctgacgtgtggttcgatttcgtggtgatgcggtatgtgccggcgatgtgtccgtcatcgaggaagccgattaccacattggtgttgccgatgtcgactgcgaccagaagcatatcgaattctccttacgattactgtattgacgctattgcttgcgattgtggttgatatttacggatattcacgatttgggcggaattgtgttgtcggtgttgcgcaatgccgacaattcggtgagtatgcgttccgccaattcctgcttgcccatcttgttccaatgttcgatgattggctcatcaggggttgcgccgggcttcaataccgtcaccacattcgtgtccaccgcgaaaccggcaccgggggtattgagattgttggccaccagcatggaacaatgcttcgacgcgagttttttcgccgcattcgcttccaaatcctgcgtttccatggcgaaaccgcacaaggtctggtcagctgttttatgctcgcccgcccacgcgagaatatcgggattcgatgtgagatgcaggtcgatattgacgcgcccgttctttttgattttctcttgagcctgctcgacgggtcggaaatcgccgactgcggccgccataatcgtcagatcggcttgcgcgaaccgttcccgtactgcgtcgaacatgttccgcgcggtggtgacgtgaatcacatcaacgccatgtggtgcgctcaatgacacagggcccgacacgagcgtcacatccgcacccatatcgcgtgcctgttcggcaatcgcatagcccatttttccggtggaatggttggtgaggtagcgtacggggtcgagcggttcctgcgtggggccggcggtaatgagcacatgtaatccgcgtaatggcaacgtttcagcaggttggttcgcacgcagcaaatcggccacggccgcttcgatcgcggcaggctcctccatgcgccctttgccgacatcctggcaggcgagcatgccggaacccggttccacaatggtccacccgagttcacggcagatattgagattgcgctgcgtcacagcattctcatacatgcgcacattcatggcagggcataggattttcggcccctcgctataggcaagcacggtgctcgtcagttggtcgtcggcgataccgcatgcgatttttgcgatgatatccgcgcttgcgggggcgatgacaagcatgtccgcccatttcgcatcatccacatgattgatatgcaacggattggaaggagtgtaggcaacatcacaatcgttgcgttgtgcggcgaacatggatgtgcgtgtttgcgtgtgcgtaagcgagctgaacgtcagcggagtgacaaactcctgtgcggctgcggtcatcaccacgcgaacctcatgcccctgcttgctccagtcggaggcgagatggcaggccttgaaagcggcgatactgccggttacgccaagaagaatatgagccatagccgtgttgtccttccgctgaccctggcaagactgatgaaaactgcgtcaagtatatatcgaaccggctgaagcatacggtatttctgttgggagaatcagccattgaagtatccgtgggcatagcggattgtaaaatcagacttcggtgatcgacctgtacaggcggtcaaccagagcaaacccataatcaaacaggagcagtcatgtcgcaatcttcaggtgcgcacggcgaagccggcgcaaccgaacagaagaacgaatcgaagggacagccgcacaacacggccagcaccgacaccacgttgaacgcgcgggccaaatcaccaaaaacgcaaggcccgaagaagtgggcctatgtgcttgtcgccgtcattgcggtcgttgccatcatcattggtgttaccgctttccgaaaccacagtgaatccaaaaacgcgaacggaacatcggccaaagccgacaccgttactgtgggtctgaaactttccccggtcagccttgacattcgtcaacagtccggagccgcgctcgaacagatcctcgacggcaacgtctacgagggactggtgtcgcgcgattcgaacaataaggtccagccaagcatcgccaaatcctgggatatttccaaggacggtaagacctatacgttccatctcaatgacaagatgaacttctccaacggccacaagcttgattcggccgacgtggtgtggtctatcaaccagctcatcgagaagcagtatctggattccgacgccatcgaaagcgtcagcaaggtcgaggcggtcgacgccgacaccgtaaagatgaccctttccgaaccggattcgaacctgctgtggaacctcaccgggcgtccgggactggtgttcgacaaggacgccaaatacgacgcgaagactcaggccgttggttccggaccgtacaccgtcgaatccttcgacccgggcaacaagatcgtgctcaaggccaatgcgaagtactggggcaccgcgcacaaggcgcagaccaacaaggtggtcgtccgcttcttctccgacgacaacgccgcagttaacgcactcaagagcggtgacgtggatgtgctctcgccggtgaacgccacgctcgccaaggggctcgacaagtcgaagtatcaggtctccgcggcatccggaagcgacaagttcgtgctcgccttcaactacaccaatccgaagctggaagacaagcgcgtgcgccaggcgatccgctacgccatcgaccacaaggagatcatcgcgtcccgcggtaacgtcgaccagacgctcggcggtccaatcccatccgtcgatcctggctacgaggacctgaccggcctgtacccgtacaatccatccaaggccaagaaattgctgggcgaagccggatactccgtcgacaagccgctgaagctcaccctcacctatgccaacacgtatggtcccgaacttggcaaccagcttaagagccagcttgccaaggtcggcatcaacctgaacatcaattatgtggaattctccacttggctgcaggacgtgcacgccaatggcgactatgagctttccttggtggaccacgcggaaagccacgatttctattcttggacgaacccggaatactacttccactacaacagcaagaaggtccaggaactgtacgccaagtcgctggcctccaccgattccgcgaccagcgagaagtacctcaagcaggcggcgcgtatcgtcagcgaggacgctcctgcggattggctgttcggataccgtgtgacggtcgcccgtgacaagaatcttcacggtttcccgggcaagcttacgcagatcctgctgccgctatggcaggtctacaagaccaagtaagttaccggtaatgaaattcatcatccaacggctggggctgttcatcgcggctctggccggtctttctcttttggtgtttctcgcactgcgcatccttcccggcgacgtcgccgcggtgattgcgggaacgaaggcgacacccgaacgcatcgccgcgttgcgctcgcagctcggacttgaccgttcttatccggcgcaatacgcggattggatacttgatctgctgcacggcgatttcggaacatccgtgatcagtggacgttccgtcgcatcccaagtgacggaacgtgtcggtatcacctttcctctaatcgttatgagcctggctatcgcactggtcatagggcttccgctgggatgcgctgccgtgctgacccgcaatccgcatctgcgtggtttgttccatgtgatcgccatcgtcgcgggcgccatccccgcgttgtggggcggactgctgctgattctgctgttcgctcgcggcagcggattgtttggattgttcccatcccaaggtttccctgatgagggatggtcggatccgtcatccgcattgtcttctcttgtattgccgtcagttgctaccggtatcactgcgggggcgtcggtaatgcggtacacgcgtgcggcggtcggcgacatggcctcgtcgcaggcggtcgatatggcaatggcatgcggcatgacccgcaagcaggcgatattgaaggtcgccttgcgtcttgccacgccgcagctcgtatcggtgatcggcctgaccttcgcgcatatggtcaccggcgtgatggtggtggagaacctgttcgcgcttcccggacttggtgccatgctcgtcaccgatgtgggcaaccgcgaccttacctccgtgcaaagcgagctgttcctgcttgcggcgttgttcctgttgctggggtttgcggtcgatttggcacaccgcgcgttggacccacgtctcaaaagtgcgggcgtcggctcgcaggaggtgtccgcatgaccgattcgaacaatcgaagcacatcgcccaaacccgtgtcatgcgcgacggttccggacggagccaagcgcacggcagcagggtcgtcggcagcgaagacggtcatcgcatccatctggcataccggcggtggcaaatacgcgatgatcgtcatcggactatgggtcgcggtatcggccatatcactgttctggacgccgtaccgtctcttggacaccgatggctaccatgtctgggcgtcaccatccggttcccatccgctgggtacggacggtgtcggttctgatgtgctgagttggctgatggcgggatctcgtaccaatctggcgatagcgttgctcactgtatgcgtcgccgctgcggttggtctgctgctcgtcgcagccatggtgtcacgcaacagtgcgtttgcctccacatcggtggtcgtcgtggacgcgctgatctccctgcccaccgtactgatcgcattgattctcacagtgccgttcggagcttcggccgcggttatcgtcatctcctgcggattcgcatacggcatgaatctggcaaggattctgcgcccagccgccatgcttgcggcgcgctcgccatacgttgaggcgtcattatgggccggggccagtccgattcgcgtgttctttacgcatatcctgccgaacaccctgcctgtgctcagcgtgcagctttccatcagcgccggcacctcgctgcttgccgaggcgggattgacctaccttggcgtgggcgtcggttcgggcgttcccagttgggggcactcgctgtccacgtcggtcagattcatcagcatctatcctatggccgtgctatggccgggtctggtggtcactgtggtcgtcatcgcgttgaaccttttcggagatgcgctgcgtgacgccatcgacccattgacgaactcggcattgagggacatctcatgagcgtgaatattcggaatctcgatatctccatcaacggcaattcaattgtgcatgacgtgcagttgaccattgcggacggcgaacgcgtggggctgattggctcatccggctccggcaagtcgatgatcgccaaagccatgatgggaatcctccccagtatggcgcaggtaagcggcgacatcgacttggatggcacacatgtcgtcggcgccaccgatgaggtcatggccaccttgcgcggccgctccgtgggcatggtgttccagaacccatccgtcgcgttgaatcccgtgatgacagtggcccagcaggtcggattgccgctgtacctccattacgacttgacgcttgaagagcgggcggagcgtgtcaagacgatgctgtcgaaagtcggtcttgccgaggatgcgctgctcaaatatccacatgagctgtcgggcggccagcagcagcgcgtcggcatcgccacggcgttgatcacctcgccgagactgatcatcgcagacgagccgactactgcattggattcgatcacacagcggcagatcgtcgatctgctgacttcgctggtcgacgattccggcgcgtccatgctgttcatcacccatgatttttcggtgctgcgtcgcgccaccacccgatgctacgtgctatccgaagggcatgtcgtggaatccggcgcgacttccatgctgcttgagtgtcccacgacgcccgaagccacaaatctggtccgggccgcgcgcgagctttcgctcgatgtcgaaggaggacgatgatggccgaaccgaccattctgcttgaaggacgtggcatcgacaagttcttcggcaaaggcaggcaacgcagacaggtgctgttcggcgtggatatcacggtctacgcgggggagtgccttgccgtgatcggcggctccggatcgggaaagaccacgcttacgcgtgtgttactcggtttggaagatgccgatgccggtgacatacgctatcgcggtgaggttctgcgcaagcagaccgtgaaatcgttgcgtagccagtccggactggtattccagaatccattcgattcgttggatccgcgatggcgtgtcgcaaaatccgtcatggagccgttgcggttgcgccaccacgactggtcccctgaacagatttcggcgcatgtggacgacgctttcctcagggtgagcctcgatccgacagtataccggaaccgctttcccatggacctatccggagggcaggcacaacgtgctgcgatcgcccgcgccattgtcgaccatccgaccgtgttgcttgctgacgagccgatgagcgccatcgacgttgccgcacgcgtgcagattctcgaatcgttcaaggcgatccgtgccgccgaaccggagatggcgctcatcatggtgtctcatgatctgggtgttgtcaaacacatagccgaccgcatcatggtggttcatgacgggcatgtcgtcgaaattggaacggccgcccaagtgctggaacgtccaaaaaacgactatacgaaacggttggttgacgccgcttcgatgtgatggactcccgcaaaagctaacccatgtccgctattcggacatgggttagtttttgccgctggaggatgtgctatcgtgtggttcatgttcaatttctcatgttgttgctgtcgctgaccaaccgcccgaggggcgcgtggttcatcgaagcataacttgagacagggcattctttcggcatccgcattctagtgggatgccatttcatcgcacaagaatcatcccatagccagtgccttacgcggttggcattacgtggctacatatgcggatgaactgcggtgaaaacaccatcgcaggtcccgttttcaaaattgcaagtgacaaacgcgagcttctcgaaatcaaaaacaacgaaatcatccatcggaagccaataaacaatcatttgcaaggaaacgccatggccatccacaattccctttccgaactcatcggcaacactccgctcgtcaaactcagccacgtgaccgacggcatcaaagccaccatcgccgtcaaagtcgaatatttcaatccgggaggctcttccaaagaccgcatcgcggaacgtatcattgacgcggccgaacgcagcggcgagctcaagccgggcggcgtgattgtggagccgacctccggcaataccggcgtcggacttgccctcgtggcgcagcagcgcggctaccgcaccattttcaccttgccggacaaggtctccgaagccaagcgcgcggtactccgcgcatacggtgccgaagtggtcgtaacccctaccgacgcgggtccggatgatccgcactcctactatcaggtggcggaacgcctcgccaaagcaattccgggagggtaccgcccgaaccagtatgacaatccgaacgggccggaaagccactaccacaccaccggtccggaaatctgggaagccagcgatcatcaggtcacgcatttcgtggcgggcattggcaccggcggtaccatttccggcaccggccgttacctgaaagaagcttccgacggtaaggtgcaggtggtcggcgccgatccggaaggctccatctactccaatccggacgacgtgcaccagtacagcatcgaaggcgtcggtgaggatttctatccgaaggccttcgaccgtgagcttcccgacgaaatcgtgcaggtcaacgatgccgaagcgttcgaaatgacccgtcgtttggctgcggaggaaggcctgctggtcggaggatcgtccggcatggccgttatggcagccctcaaatacgctcgcgagcatgatttggatgaaaaccagctggtagtggcgttgctgcccgattccggccgcagctatatggagaagatcttcaacgacgattggatgcgtgccaacggattcgccgacgttgtggaacgcacgtccaagccaagtcttgcggagcggtatctgtaaaccgccgatcagctgcttcacgatcatgcccatcattcgttcaacccaaaccattcgctattttcaaggagttcccatcatgaccatctcgaccaacaccgaagccctgaacgccaccgcactcgccacccgcgccattcacgcaggacaggaacccgatccgactaccggggccgtggtcacccctatttatatgacatccacgttcaagcaggatggtgtcggcggcctgcgcaacggttatgattacagccgttccatcaatccgacccgcaattccttcgacgagcagctagcggcggtcgaaggcgcgaactacgcgctgagcttcgcttccggactggccgccatcgacgtgctgctgcgtgccacgttgaaaccgggcgacaatattctgcttggcaatgacgtgtatggcggaacctaccgattgctttccaaggtgttcgtgccgtggggagtcggccttgacgtggtggacgtcaccgatacggctgccgtttccgcggcgctcagccagaagcagtaccggtacatttgggtggaaaccccgtctaacccgctgctcaacatcactgatatcgcggccacgtcagctgtcgctcacgcgcatgacaccaaagtggtggtggacaacaccttcgcgtccccggtattgcagcatccgttggcggacggcgccgacgtggtcgtatattccaccaccaaatacatcggcggccattccgacgtggtaggcggagcggtggtgctcaacgacagggaaatccgcgatgaagtggcgttccttcagaatgcggccggagccgtgccatctccgttcgactcttggcttgacattcgtggcctcaaaacgttggatctgcgcgtcaagcagcacagccgtaacgccatgaaggtggcgcaatggctggaaacccgccctgaagtggaacgcgtatggtacccgggactggaatcccatccaggccacgagattgccgcacgacagatgcatggaggcttcggaggcatgatctccgtgcagatcgcagctggattcgaagcggcaaagaagttcgctggtgccacggaagtgttcaccttggccgagtcgttgggcggcgtggaatccctgattgagcatccgggcgccatgacccacgcttccgtcgccggtaccacgctggaagtgcccgccaatctcgtgcgactttccgtcggtcttgaagatgctgacgatttgatcgcggatttggaacaggcttttcgccagatctaacaaaaatcagcttgtgataaagccatcatgagaatgtgacaattttgtgtaatctgtcacattgttgcgacatgtataaatcctcgccatcgaatgagctggaagcgtatcttttcctttcctactcaggctatggcgagggttttaccatataatgcccctgacagcgtcttgttcttcccatagcacacttcttacgggaagagacggcaatgattatcgagacgaggcggcatgctgcaaattcaaggcatctccaaacagtataaaaccggcgacttcgtgcagcgggcgctggataacgtcagcctaaacctgcgtgacaacgaattcgtggccattctcggtccttcgggatccggcaaaaccacactgcttaacatcatcggcggacttgaccattatgattccggcgatctggtaatcaacggcatttccaccaaacaatacaaaagccgcgattgggactcctatcgcaaccacaccatcggtttcgtattccagagctacaatctcattccccatcagaccattctgtcgaatgtggaacttgccctgaccatttcgggcgtatcgcgttcggagcgtcgagaacgtgcgcgcaaggcgcttgaacaggtgggtttgggcgaacacatcgacaaaaagccgaaccagctttccggcggtcagatgcaacgcgtggccattgcacgcgcgttggtgaacgatccggatatcgtgctcgccgacgagccaaccggtgcgcttgattccgacacttccgtgcagatcatggatctgctcaaagaggtcgccaaagaccgtcttgtggtgatggtgacacacaaccccgaactggcctaccagtatgccacgcgcattgtggagctcaaggacggtgtgattcgttccgactccgacccgttcgaaccagttcagaacgaaacggccactgctcccgtgcgcaagaccatgggccgcacatccatgtcgttcggcacgtcgttggcattgagcctcaacaatctgcgtaccaagaagggccgcacgttccttacggcattcgcaggatccatcggcattatcggcatcgcattgatcatgtccgtttcggcaggcgtgaacacgtatatcgacaatattcagcgcgagacgatgaccgcttacccgatcagcatcgacgaacagaccttcgatctgaccagcatgatgacttccggtcggcagaatgcggacaatcaaggcaagaagcataagagcgacgcgatttatccggatgatgccgccatcaagggcaccgcttcgatgaccagcagcattaccgaaaacaatctgagcgcattcaagaaataccttgataataaggacagcgacatcaatcggtatgtcggttccgcgggaatccagtattcgtatgatacgaagttctccgtgttctcacacgatccagacggcacgcttgtcaacgccgatggtgtgacggtgggtaataccggcaccaaatcgatggccgaccagatggcggatggttcgctgatgtctgccgactcgtccacctttacgtcgacgcgcatgagcatgctcacgggtaaaaccgaccagaatgccgcaccgagctcattccatgagatcatgccgagcgctgacggcaagaagaacgtcggcaaggtcatttccgacaattatgaggtagtcgaaggatcctggccaaagaacaagaacgaagtcgtgcttgtacttgatgagaacaattcattgtcattaaccactgtgtatgaactaggcctcaaatccgccagcgaataccacaatatgatgaaccagctcaattccggcgacgatgtgaaaacagataccaagaagattgactattccgacgttatcgaccgtacgctgaagctgctgccgacctgtgaccagtatgtcaaaggcgataacggccattggaagtacgtgggcgacgatgtggaccagattaacgcgctgattgactccgacaaggccatcaatctgaagatcgtgggcgtggtcaagccggtagaggatgctgacgcaactccgctttcctccggtgtgggctatacgcgtgcgctgaccaatgagctggtcgaccgtgccgaatccagtgaaatcgtcaccgagcagcaggccgataaagaccataatgtgctcaacggcatgacgttctccccgtccgatgatgtcaccaaggctcaggacgctcgtgactatgtcgcatccctcggcgtgagcagcaaggcgcagatggcgcagaacatgatggccgctgcaggagcatccggaggcgactcccagcaggccgcggccatggctcagatgagcgaacagcagctcgccgatcaattcgacgcctatatagccaccgccgacgaggccacgctggtcgctatctacaaccagtacgtgtccaccggctcctacaacgacaatctcactgatttcggcgtggtcagccgtgacgcaccaagctccatcaacatttacgttgacagcttcgaagacaagaattccatcaacgacgccatcgacgaatacaacaggaccgccaaagaaaaagacaagatcacctacaccgactacgtcggtctgatgatgaactcagtaaccaccatcatcaacgtcatcacctatgtgctgatcgctttcgtggctgtgtcattggtggtttcgtcgatcatgatcggcattatcacctatatttccgtgctggaacgtaccaaggaaatcggtatcttgcgtgccatgggcgcatccaagcgcaacgtgtcgaacgtgttcaacgcggaaaccggcattatcggcctgttggccggcctgatcggcgttggcgccaccgtgctgctcaatttcccaatcaacagcgtgctgcaccacttcatgggcaccaccgaggtcagtgccgtgctgccggtcggtaacgccatcgccttagtgatcctcagcgtagtgctcaccctgatcggcggtctcatcccaagtcgtggtgcctccaagcaggaccccgccaccgctctccgcaccgagtagaggcggttttggatactagactgctgcgtatgacagagtttacgtcggcgcgtgacgccctccgcacctacttcggatatgacgccttccgtcccggtcaagaaggcatagtcaatgcgattatccaaggccgtgatgcgctcggtgtcatgcccaccggtgctggcaagtcgatctgctaccagattcccgccacgcttcttccgggcatgaccatcgtcatttccccgttgatctcgttgatgcgcgatcaggtcgacgcgctcaacgacgtgggcatttcagccgcgttcatcaataccacgcaaagtcccgacgaacaggatctggtgttcgcgcaggcgttgtcgggacggatcagactgctgtatgtggctccggaacgtttggaaaccgaacgtttccgcacgttcgccagtcgtgtgccgatttctctggtcgccgttgacgaagcgcattgcgtgtcgcaatggggtcaggatttccgttcgtcatatcttggtatcggcgattttctgaaggcattgccgacccgtccgacggttgccgcattcactgcgaccgcgacggaacgggtgcgtcgcgatattatcggaattctcggattgcgcgatccgtccgtcaccgtcaccggcttcgacagggccaacctgtatttcgatgtgatcaggatggaaaggaaatataaggcttcgtgggtggcttcatatattgcggatcatcctgacgaatccggcatcgtgtattgcgcgacccgcaaggaagtggagtcgcttgccgaatcgttgaatatcgccgtgtgcgagctgcgtgctacgaaaggtgaggatgcgacgcgacttggcatggtcgcagtcgcctatcatggcggtatgtcggccgaaacgagggaacgggcacaacgtgatttcgtaaccgaccgtgtgcctgtggtggttgccacgaatgcgttcggcatgggcatcgacaagtcgaacgtgcgttatgtgatccaccataatatgccggaatcgatcgaagcgtactatcaggaggccggtcgtgcggggcgcgacggcgagccgagccggtgcacgttgctgtggaacgaatctgatattgctacgaggcgaaggctgcttgattcggattatgagaacgagcgtttgaccgccgaagagcaggaggtcgtgcgtgcgtcgaaacggcgtctgctcaacgccatgatcggttattgccgtaccacggattgtctgcacgagtatatgaccaggtatttcggtgaggccgggggagcggccgtccgtgatgacggcacatgcgtgggaggatgcgcgaactgcgggaacacgtttgaaaccgttgacgtcacggatatcgcgcgggccatcagccgctgcgtgcatgacgtgaaccagaaggtcggttcggggaagatcgtcaaagtgctgcgaggatcgaaagcgcaggatttgaactatcttcatcctgccgatctgccgacgtacggcatgttgagcgcgacttcggaggcgcagattcgtgacgtgctcagccagatggcgacggatggttttctttccatttcggaaggttccatgccgatcgttcgcttcggtgaacgtgcggcggaaacggtcgcgccgaattttcattatgaaatcaagaagatcgaacggaagcacgctgcgaaacgtgcagaatcgccgtccgcaggctctcagactatgggatcgtatgtgccgggcgacggagacgaggaattgttcgccaaactgcgtgcgttgcggcttgacatcgcccgcgaactcggtaaacccccgtatatcgtcttttccgataaaacgctgcgcgatatggtgcgtatcaggccggtcaccggcgagcaattctcgcaagtcaatggcgttggtgcgctcaaattggaggcgtatggcgaacggttcatggaagtgatccgcgatttcgttgcatgaatcaggtgacgtgtcagcttgaggaataagcgtatcgattattgcaagatcatacgttttatatgatacgtaacacgttatcggcaacatgtatggcggtgaggttgacgtatgccggcaaaacggcgacagtagagacgaacagttgttgaagaaaggattgatgatggcagaagacaagccggttgtggaaagcttccagctcgaccacaccaaggtgaaggctccgtatgtgcgttatatcgacacgcagaccggtccgaatggcgatgtgatttccaattatgatttgcgtttggttcagccgaatgagaatgcgattccgaccggtggcctgcacaccatcgaacatacgattgcggtgctgttgcgtgaacgcatcgacggttatatcgattgttccccgttcggctgccgtaccggtttccacctgctgacgtggggtgagcattccacggaagaagtggcgcgcgcgttgaaggaggcgctggaattcatcgcatatgaggccacatgggatgacgttcctgccaccaccattgaaagctgcggcaattaccgcgaccatagcttgttcacggcgaaggaatggtgcaaggatattctcgccaagggcatcagctctgacgcgtttgagcgccgcctggtctgattcgcgtgcgattgcacgtcttttttcgggcatgttgcgaatactgtgccgtgggcatggtatttttgacgctcggaagaagacaaggtgatgcaaaggtgaacgagatgggtgaggagagcgtcattacctctgaacggcggttccgtcgcgccactatggccgatttgccgaccatgctgaagatttatgagcatgcccgcaagttgatggcctccaatggcaatcccacgcagtggggcgataagttcccgcgtgaggaagtggttcgtgacgatgtcgaatcgcaacgcaccgtgctgctggtcgatacggttgatggcaaggagcgtgtgctcgcccagttcgcattgtgtccgggcatcgacccgacgtatgtgaatatcgatggtgcctggctggatgacgatccgtatgtgaccatccaccgtatcgcctcgtcggggctcgccaagggtgcggcgaaggactgcatcaactggtgcatcgaacattacggcaatgtgcgcgcggatacgcatcccaacaacaaggccatgcagcatgtgctcgaatcgaatggtttcgcgcgctgcggcttgattcagttgcttgacaggccgtccgacaccacgcgtatcgcttatcagcggcatgaatggtgagatttgcggatttatatggattgatatcaatcaatataaatttcatcacaaataatcgcaaataatcttcgatattgagaagcaaaaatcccgttgcatatcgtatttcagatgttcaacgggatttttatatccgattgtgttgctttcgatatatcttacgaaagatatatcgaaagcaaccgtatcgtcggtttttagaacagtcctggctcgttcaatgcggaatgcttgcggctgtacacgaaatacacgatcaaaccaagggcgaaccagattgcgaaacgcacccaagtctcccaattcaaaccgcaaatcaggatgaagcagaaaatgatcgcgcagatcggcgtgaacggcacgcccggggcgcggaagccgcggtgtgcgtccggctgggtcttacgcatccacagaatgcccgcggacacgatgatgaacgccgacagcgtaccgatgttcaccaattcgaacagcacgttgatgttgatgaaaccgccggcgatggccgttagaataccgaagaaccatgtacctttgaacggggtgcggtatttcgggtgcacttcgccgaagaacttcgggaacaggccgtcgcggctcatggcatagcagatgcgggactggccgtacagctgcaccagcatcaccgtggtcatgccgatcagagcgccaagattgacaacgaacgccagccagttgagaccggtttcgagaatcacgccggccaccggagcgtcaatgaagttcgcgaactccttgtatggcaccacaccggtcatgatcagcgtcatgacgatgtagagcacggtggacacggccaacgagatcagaatgccgcgcggcagtgtcttgttcggattgatggtctcctcggcggaagaggacaccgcgtcaaagccgatgaagctgaagaacacgatcgacgcggccggaacaatgccgtacggctgcgtcgagcccggctggaacgtgtaaatgccgtacggggagaacggcttccaattggcgggattgatgtaccagacggtgcacacgatgaacagcacgatgatggccagtttgatcatcaccataatatcgttggttttcttcgtctggctaatgccgatggacagcacccaagtgatgatgagcacgatcacgaaaccaggcagattgaagtatgtggtcacgcctggtgtggtgccgtatgccgcggtcagctcaactggcagatgcaagccgaaaccttccaacagtttgttgaaataaccggaccatccggcggacacggtggccgcctgcaatgcgtattccaaaatcaaatcccagccgatcacaaatgcgatcagctcgccgaacgccaaatacgcgtacgaatatgcggaaccggacactggtgccattgctgcgaactctgcatagcacaatcctgcgaaaccgcagcagaccgcggccaggaggaaggagacgcacaatgccggacctgcggtgagggcgcccttgccggtgagcacgaaaatgccggtgccgatgatggcgccgattcccagcatggtaaggtcaaacgttttcaatgtgcgtttcagtggagttgactcggatacgagctggtccactgactttttgcgaaaaagatccatggtcttaattccctaaaagtggttttatatgggctggaccggacggatttccgggactctggcacgcctcaaacgccagaaatcaaagaagggctgaacgcctcatgtatgggaggtatacgcgccttatgtaaggagagtgtaaaaacctggcacggacaaaaccgtgaaaaccccgtgaatcgtctcgctaagtgtgcgcgttttttcgaagccgtcacgtgggagcgcaacaatagagtcatgactttcaacgctgcccgtgaatggcaattctcatccgaacaaggcaaggccaattatgaggccgcccaaaagcaatatccggcgcaggccatcgtcgatatggccgcattgcgaaacaacatgcgtcatctggtgagcgtggttggcggcccgaattccggcaccgccgtgatgggtgtggtcaaggccgacgcgtacgggcatggtcttattccggccgcgctcgcggcactggcgggaggtgcgacctggctgggcacggcgcaatcacatgaggcgctgctgctgcgcaaggcgggcatcgggccggaccgctgccacattctgacatgggtatataacggcatggctgtgccttttgacgagctgatcgacaatgatatcgatatttccgtcggatcattgccgggcattgacggcgttgcggctgcggcgcgtcgtcttggaaaaaccgcacgcgtgcatgtgaaggtcgattccggtttcggccgcaacgggttcacgcccgccacgttcgacgcggcgctcgccaagctggtgccgctcgccaaggagggtgtgctgcatatcgtcggccagtggagccatttggcggtggcggacgctccggacgttcctgaattcgtggcatccaccgacagacagatcgagaatttcaaggatttcacccgtcgtatggagcaggcgggcattgcgccggagattcgtcatctcgccaataccgctgccacgctttcacgttccgagattcattttgagctgacgcgcccgggtatcggcctgtatggttatgaggctgatccggccatgggcacgccaggtacatacggtttgacgccggccatgacgttgcaggcgcagcttggtacggtcaaggatgttgaagcgggccatggcatttcctatggccgcacgtacctgactccgtccgatacgtccaccgctatcgtgcctgtcggctatgcggacggcattcaccgttccgcttccggttttgatatggaaggcgcgaagcatgtggtcaagccaggaggcccggtgcgtgtgatgaccacggaaggtccgcgcctctaccgtgtgtccggtcgcgtgtgcatggatcagtttatgcttgacctgcacggttccgcggaaaagcttggcgtgcatgagggcgacaccgtgcagctgttcggaccggggcgcggagaggattatgccgagccgaccgccgacgattggggccgtgccgcaggaaccatcagctatgagatcttcacctgcctgtgcaaccgtatcccgcgcctgtacgagcatgcctctgacgtgctgtcggtcgaagatctcgccaaactcgatcccgcaaccctcctataaagaatcaggcgtgcgatgggaggcacgccgtgaaagtcaatatggtgggcgcggtacgttcggcggttggtcaacgtgccgcgcttgctgttaaggtggtgagctatgccaggaatgattctgaaggaagatatcgaaaaagttcgcgccaccgccgatctgtacgacattgtgtccgcaacggttacgctcaaaccttcaggaactggcacatacgtggggctgtgcccgtttcatgacgagaaaacgccaagcttttccgtgcgtccggcgctcggtgtgtggcattgcttcggctgcggtcttggcggagacgtgttcggctatgtggagcatcaggagaacgtcgactttcgtgatgccgtcgagcttttggccgaccgataccatatcgaattgcgttatgaccagtcgaacgccaagaaggagcataccggttcgaaacgtgcccgcctgttggaagccaacgaggccgcgcaggagtttttcgtctcgcagctgatgaccaaagacgcgctcgccgcgcgcaaactgcttgatggccgtaatttcagccaggccgattgccaacgattcggttgcggatatgctccgcaaggctgggataatctggtgcggtacttggcaggcaagggcttcacacagcaggaaatgttggacgcaggtttggcccgtcaaggccagcatggggtgtatgactatttccgtggccgcgtaacatggccgattcgcgattcaaccggacgcacgcttggtttcggcgctcgcaagttgtatgaggatgattcgattagcgcgaaatacattaatactcccgacacgcagttgtatcggaaaaaccaggtgctgtatggcattgatatggcgaagtcggcgattgtgaagaaacgtcaggcggtgatcgtcgaagggtatacggatgtgatggccatgcatttggccggcattgataccgcgatcgcgacatgcggcaccgcgttcggtgccgagcatgccaagatcgtgcgtcgtctgatcgccgacgattcgttgggtgcggtacagctggttggtccgttgaaggttgaaggacaggcgttgagttcgcgtatcgtgttcaccttcgatggcgatgcggccggtcagaaggctgcgattcatgcgttcggcttggattccgctttttcgacgcaggcgttcgttgctgtggccgacgacaatctcgacccgtgcgatttgcgtatcaagcgaggtaatgaggcggttcgcgcgttgatcgatcatgccgaaccactgtatgatttcgtgatcaaaaccgcgatcgggcgtttcgacaccacttataccactgggcagatgggcgcagtcaaggcggtggcgccgttgatcgcacagattcgtgaccgttccctgttggatttgtattcacgcaaggcggtgcgccagatcggcgtcgacttggatatcatgcagcgtgaagtgcgtgacgcacgacgcaaactgcaggtgcgggacgaagatgcgtacgctccgaaacgtcgttttgcaggcaatgccggagctgcggtggaaccgcgtatggaacaaggcacgaatccgtatgcgaatccttccgcgcggaaggcgttggaacatcgtgatgcggcggagcaatcctactatcgcattgatgatgccgtgttcatttgcgaacagcagttcatggcaaccctgattcaagtgccgcttgccgttgatccgacactgttcgccagtcttacgctgtcgagcttcatgacccccgtattccgcacgttattccaagcggtcgcggcggccgggggactgccgtctgctgataccccgcaaggattgtggatgcacaatctcaccaaagcgggtggtccgatgttggaatccgtcatcaacgagcttgccgtcatgccattgccgcttcctccgagcgatactgacgcagaacgtgcgtcgcaacaatcgcaggaaggcaacgtgcaattgcgcaagccgaccgacgacgaacgcagatacgcgtctgaactcatcattcgactgcttgacacgggcatcatgcgcaaaatcggcgcggaccagcgtcgcatggcgcaactgccggacggtgccgagaaaatcgagctgcttggccagattaccaagctggaaacgttgcgcaaggatctgcagacgagggtgttcggcaataacgtcgcctgaatatttggtgtgccggagcgtcaacccccgaacgtctttgtcgttcacctgaatttgccacatgcctgagtgcggtatgaacagccggcgaacgtgtggtgaacgcaggaagaatacttaacgaattcttggctggtgcacggtatccttcggcgtgttttgcaattgcaaaacagttttgccggtttgcaaagtcagggaacagtaaggcgcatggactgaaaaacgttggaatggtcggaaaaatagtatgccaagggtatgtggtacgcgatttttcgggtaaagtgaatacggcgtttcttgagtaaatcgcccgggtctgcaaacggtttgcaaactggattcacggaggaatgaatgcgacgattggtcgtcaaaatcctgaaaaacgagaccattctcgtagttgcttccatacttgctcttatttcatgctttatcgtgcctcctgacaaggagtatgccggatatattcatgccagcaccatttcgcagctgatctgcctgatgctggtggtgtgcggtttccagcgcatcggtgtgttccgcatcatcggttcgcggttgctgcatcatgtgagcaccgctcgcggattggtgatcacgctgatttcgctcacctatttttccggcatgctgattaccaatgatgtggcgctggtcacgttcattccattcgcgatcgcggtgctcaccatggctcacatggaggagcatgcggtgctggtcggcacgttgatgaccgtcggtgcgaacgtgggcagtatgttgacgccgatcggcaatgcgcacaacctgtatttgaaagcgttgacgggcatgccgtccgctgaaatgatcggcattatggcaccgtattccgttgctgcggcggtattgctggtggtcatcgcctgtgtggtgttcggtaagaaacctgtttccgaattttcctctatcgacggcaacggcatcgaacagaatgtgctcgctccgaattccgatcagccgcagccggatgagattcgtgtgaccggctacggcgcaggttacggtggttggcgcacgatcgtatattgcgcgctgttcatcgtgtgtttgctggctgtgagcgatttcattccgctatgggccatgtgcgtgatcgtggtggtggcgttcctgttctgcgatcgccgcgtgttccgcaatatcgactggggattgccgctcacgttctgcatgttcttcattttcatcggcaatatgaaacgcgtgccggaattctacgagctggccgcctccttggtgggggcgcatccgctggaagtgtccgtggtgtccagccagttcatttccaacgtgccgaccacgttgctgctgtcgggcttctgcgaccagtggcgtgcactgatcatcggcaccaaccttggtggcatgggtacgctgatcgcatccatggcctcgctgatcggctacaagaacgtgacgcgtaagtaccccgataagaaggggcgctatctggccgtctattcggcggtgaatgtgctgttccttatcgtgctggtcggtttgagctggattatcgagtagcgtttggccgtcgaccggtttccctgaccgctaatctcaaggtcgccggttcgcaccttttgctgggattgcatgaaaacccttggaatcattggatttcaagggtttattgttacgtcggctgatggtctggtgctgtgataatctgtgccgggaagcgtgtgccgagaaacgtaggaaggctgaacatgctgcaaggattgctgggaattttctccggactgatcacgccggtgcagaccgcggtgaacacgcggctcggccgttccatcggctcgccgttgcgcgcctcgctggtgtcgttcagcgtcggcctcattgcgatgctgactttgacgctgctgcttggcccgtatccgctgattcccgccaccgcggcgaacggcccatggtggatgtggttcgcgggcgtgttcggtgtcactttcctgaccggcaatgtgctgctgctgccgaaactgggcagtctcaaaaccgtgatcatgccagtcaccgggcagatcgtcatgggcctgctgatcgacgctttcggctggttcggcactaccgcgcagccgatttccccgctgcgtatcgcaggcgcggcgatcacgctggtcggcttcctgcttgccgtcgccggaccgaatctgcgattgaggcctgccatcgatcgctcggctggcggttcggaaaattccggcgattccgaaaaatccgaaactgacggaaaagccgtacatgtgccaggttccgcgaccgtgctgtggagttgcgcaggcatcgcgttcggcatgtgttcggccgtgcagacggcgttgttgggcaagctgggcgtcgcgttgggatcgccggtgaaggcatcgctcgcctcgttcgtggtcggtctgatctcgcttgcgatcgtcgtcgcattcgtcgaccgcacctacagcctcggcgacgcgctgaagaaaggcaatccgtggtggatgtgggtaggcggattgctgggtgcgacgctggtgatgtgcaacgcgtacctgtccgcgcatatcggcaccggcatgacggtgatgctggtattgctcggtcaggtcggcggaggattgctggtcgaccgtttcggcctgcttggcgtgccacgcaagcccgtggccggcatccaatacgtcggcgtgctcgtagccatcgtcggcattgtgctcaaggcgatgtgattgccgtgtcgagttggcaaccgtgtgcgaactgactatactgtgtttagtttggccctgtagctcagctggatagagcatgtgacttctaatctcaaggtcgccggttcgagcccggccggggtcaccatcaagccctcgcgtcgtttcatgcggtgcgggggctttcctgtccattgaacggcaagccattggctggcgaagataggggagaccatgaagcgaatcgtcgcgggcattctggcgcatgtggacgcgggcaagaccacgttgtcggaggcgctgctgtacgctaccggccaagtacgcaaactcggccgcgtcgaccacggcgacgccttcctcgacacggacgccatggaacggcagcgcggcatcaccatcttcaccgagccggccgtcatcgccacgcccgacctcaccatcaccctgctcgacactcctggacacgtcgacttctccgccgaaacggaacgtacgctcgccgtgctcgactacgccatcctcgtcatctccggcgcggacggcatccaaggccataccgaaacgctgtggcgactgctcaatcgctatcaggtgcccacattcgtcttcgtcaacaaaatggactcgcccggcgccgacaaaacgcaactgctcgcccaactcaagaaacgcttctcggacggctgcgtcgacttcaccgagccgattgacggcgaacgcatggaggagatcgccatgcaaaacgaaacggccatggacgcgtatctcgacaccgaaaccgtgccggacgaaaccattcgcgccatgatcgcccgccgtgagctgtttccctgttatttcggatcagcgctgaaaatggacggtatagaacagttcgtcgcaggtttcgaacggttcgcgcaagagccgcaatacaatggcgaattcggcgcacgcatatataaggtgtctcatgacgcgcaaggcaaccgtctgacctggctcaaggtgaccggcggcgaactgaaggccaagatgatgctaagcggcaccgcgcacgccggcgacgcggatgtggttgccgaagacggccaatggcatgagaaagccgaccaggtgcgcgtctattccggcgcgaaatccaccaccgtcgacacggtccccgcaggcaccatctgcgccgtcacgggtctgacgcagacattccccggcgaaggcctcggcatggagcgggacgccggcagtccggtcctccagccggtgctcacgtacacgctggaaccgggggagtgcgacattcacaaatgtctcgtcgccctacgcgaactggaggacgaggatccgctgctgcacgtcgtctggcagtctcgcctagaggaagtgcacctgcaattgatgggtgcggtgcaattggaagtcatccagcagatgatgcatgaccggtttggcttggacgtcacgttcggaccgggcagcatcctgtacaaggagacgatcgccgcgccggtcgaaggcatcggccatttcgagccgttgcgtcactacgccgaaacgcatgtgctgctcgaaccgctgccgcagggctcgggcatggcatacgccaccgtgtgcagcgaggacgtgctcgaccgcaactggcagcgcctcatcatgcagcatttccaggaacgcgagcatctgggcgtgctcaccggctcgccgatcaccgatatgagaatcacgctgctgacgggccgtgcgcatctgaagcacacggaaggcggcgatttccgtcaagccacgtaccgcgcgatacgccagggcctgatggaagcgaagaagaagggcgattgccgtctgcttgaaccttggtacggcttccgtctggaagtgccgcaggacatggtcggacatgcgatggccgacatccagcgcatgtcgggcacgttcgacacgcctaccggcgacggcgaatatatggtgttgaacggcacggcgccggtatccgaaatgcgtgactatgcgatggacgtgaacgcgtacacgcacggccgtggccatttaagctgcgtgttcgccggctaccagccgtgccacaatgccgacgaggtgatcgagaacatggcttacgatccggaatccgacctggagaacacgccggattcggtgttctgcgcgcatggcgccggctatccggtcaaatggtacaaggtccccgaattcatgcacctcgactacgcctggcacggcgaagaggcgtaaaacatgtagataggctgccgacgccggactgtgcaaagttccgcgtgtcggcagtttttttttaaaaaaaacgcgagtggagtagatgtgtgagaaaaagaaaaccccacacgaggtggggcttggtggagcggacaacgggactcgaacccgcggtctcaaccttggcaaggttgcgctttaccaactaagctatgtccgcaaagaacttccgccgtgagaagcggaaattcagtgggtgatataggaatcgaacctatgaccccttccgtgtgaaggaagtgcgctagccgctgcgccaatcacccgtgggataattccaccggtttcccggcttcgttacccgcttcgcgtgggcgatacaagattcgaacttgtgaccccttccgtgtcagggaagtgcgctacctctgcgccaaccgcccgaagcgagtgctaacttacgtggattctcggcggaatgcaaatcgtcggcgtgtcgcgatggtgttgcgaggggtgactcgccgtcaattagcgatcgaaaccattggaatttccatggtttttgcgtctggatcggactcgacgaacgattcttcagaaggggattgcgtcaacggcaagcgcatctgatgccatgccacattgccgtgcgtcgaagcagacatgccttcgtccacgaatcccaggcgggcgtaaaatccgacaagacgttctttgcatgtcagcacaatgcctttgcgtccggcaatcgtcgaatcaaggatcacacgacgcagcagatagctggcgcaaccgcgatgctggtagacgggagccacatccacgccgaaaatcatctgccaatcaccctgctcgtcatgcatggaaacatcctcatacatgacatcagccaaatctttctcattggtcgtcatgccattgacgaaaccaaccaacgtgccatcttccacggaagcggggaagcaggcgtcgtcatcggcgtcagtgttgatcaaaagccagaaatgttccggatatgtggcgacgcgtgcggtcaggctctcgttcgttgcggcctccgcaggcgggaagcaggcagcctccacagcctcaatcgcgtccaaatcctccatcgttgcatgtcgaatgagcatgtgcatactctctcgcaaggcatacccaatcttcacatttcgatatgagctgacggcggaaagcgccgacgtgcaatactgtggcaaggattaccgggaagcatttcttgaaggttgataaacgcttatacgaaaaaccgataacgacgtggcctgttccgtgattatcgcgcggtacgatggggcgcgttcaaggctaaagcttggaaacagcctgagaaggcttcaaacgatccgcagaacattcgaaaacctagcgagaaagaggggaggcgcgtgtgttcgactggacattcgtgacgcactacgcgccgttcttcgtcaacggtgcggcgatgacgttgttcatttccgtattcggcatcgtgctttcgattgtggtcggtctcatctgcgcgggcattgaaatcgcacgcatcccagtgttgaagcagattgtgcgcgtctacatcgaactcagccgcaacacgccgttgctggtacaactgtatttcctgtatttcggtctgccgaagcttggcgttgtctggtccgcggaacaatgcgcgatcgtgggactcggctttctcggcggctcctacatggccgaagcgatgcgtggcggcctcgaaaccattccgaacgtgcagcgcgaatccgcatacgtgctgggcctgagccaatggcagaccttgagccgcgtggtgatcccgcaggccattggcacgtccatcccaggcattgtggccaacgtgatcttcctgatcaaggaatcatccgtcgtgtcggccatcgcgctcgccgacgtgatgtacatggccaaggatctgatcggcatgtactacagcacgtacgaatcgttgctgatgctggtcgtcgcgtacttggtgattctgctgccgatttcattgttcggcacttggctggaacggaggttcgactatgagcggcgctgagattctgctcgagccgggcgtgttcccgcgcctgctgcagggcctgtgggttacggtatggatcgccggcgtttcggtgggtctttccattcctgtgggattggtcgtcggctggctgatgacgatgaaaaatcccgtcatccgtgtgctgaccaggatttatttggatttcattcgcatcatgccgcaattggcgttgctgttcatcgcgttttacggtttcgcccgtgcgtggaattggaatttggatgcgaccggcgcatgcgtgttcgtgttcgtgctgtggggcggcgcggaattgggcgatttggtgcgtggcgcgcttgagtcgattccgaaagcccagtatgagtccgcgtatgtgcttgggttgagtggctggcagacgttcgtcacagtgattctgccgcaagcgttgcgtaggcttctgccggcttcggtgaatctggcgacacgaatcgtgaaaacgacgtcgttggccgtgcttctcggcgtggtcgaggtcatcaaagtgggtcaacagatcatcgacgcgaaccgtttccaatacccgaccggaaccctgtggatctacggggtgattttcttcatgtacttcatcgtgtgctggccgctgtccatcgtggcccgccgactggaaaagaggtggtcgcatgactgacgcagcgggcaagcagactcaggcaggccaagcaagtcttgggattgcgcatttggtcaagcagtacgccaatgccgacaggccagtgctgaacgatatttcgttcgacgtgccgcatggcaaggtgtttgtgattgttgggccttccggttccggcaaatcgacgttgttgcgcaccatcgcaggccttgagccgattcagggcggcaccatttcgctcaacggcgaagtgatcgaaacgggcaagccgggcactgagtccgctggacgcagcaagcgcagcagcgaactacgcacccgcgttggcatggtgttccaaagctacgacctgtttcccaacaaaaccgtgcttggcaacatcacactggcgccgaccttggtgcagaagcgagataaggccgcagtcgagcaggaggcgatcaggcttctggaacgcgtcggccttgccgaccgcaaggattcctggccgcacgagctttccggcggccagcgtcaacgcgtggccatctgccgtgcgctgatcctgcatccggaagtgctgctgttcgacgaagtcaccgccgcgctcgatccggaaatggtgcgcgaagtgctcgacgtgatgctcgaactcgccgattccggccagaccatgctcatcgtgacgcacgaaatgcaattcgcgcgagccatcgccgaccaggtgatcctgcttgaagatggcggcattgtggaacggtccgacgatgccgaacgattcttcaccaatccgaccaccgaacgtgccaagcagttcctgcatacgtttgaattcgaccggcatcgcaagtccgccgagcaatccgaacggtccgaacagtagcgcgaaatagcgcgaatcggcgaaacccaagattttgatagcagtcatctttgcaagagaggagaaaccatgaccgcatcaatcatcaacaaaacattcaagagcatcgtggccgcatcggccgcgttgatcatggcagcctccgtggctgcttgcggtccgtccgcggccactccgagcgacgaaggctccacgggtagcgattccagttccagcagcagcgccaccgcccgcactctggatgagatcaagaagtccggcaagctcaaggtcgccgtgttctccgacaaggctccgttcggctacgtcgacaaggacggcaactatgccggctacgacgtctacttcgccgagcgcttgggcaaggatcttggcgtagacgttgaatacacctccgttgacgccgccgcccgagtcgacgtgctcacctccaacaaggtcgacatcacgctggccaacttcaccgtcaccgacgagcgcaaggagaaggtcgacttcgccaagccgtacatgaaggtggcgttgggcgtcgtttccccggaaaacgccgaaatcaccgacgttgaccagctcaagggcaagaccctgatcgtgaccaagggcaccaccgccgaaaccttcttcgagaaaaactaccccgacatcaagctgcagaagtacgaccagtacgccgatgcctacaacgcgctgctcgacggccgtggcgacgccttctccaccgacaacaccgaggtgctcgcatgggccaagtccaacaagggcttcaaggtcggtatcaccgaactgggcgataaggacaccatcgctgccgcagtgcagaagggcaataaggaattgcttgactggatcaacgacgaaatcgacaagcttggcgatgaaaacttcttccacaaggattatgaggagacactgaagccggtgtatggcgacgaagtcgatcctgatgaaatcgtggtcgaaaaaggtgtggtcgactgataactagttaatcaaactaaatattttgagccttccgtcgcttcaggcggaaggtttttctatattcacataatcatatttacatacaaatatatgattgctgataacgctatataaaaaacaattattacgattcgcgccttccataaaaagcgtatatagccacgccgatgttgccatgttgtttttccgatatcttgtgattgtcggcttgaaaaacaagcgagatgttttacgagagaggagcacggaacatgaagtacgcagtgatcggtgccggcggaatgggcatccagtacggtgtgctgctgcaggaattcgcgcacaaagacgtcgacttcgtcgatacatggaagccgaacgtcgagaagatccgcgagctgggcggtgcctacgtgtcgcaagacggtgaagaccgccatctcgtgccgatcaacgtgtactatccggaggaatacgccggccagccggacgtgtggatcgtgttcctcaagcagatgcagcttgacggcgtgctcaagcgctgcgcccatctgttcaatgagaagcagatcgtgttctccgccatgaacggctatggacacttcgaaaagctcaacgaatacttctccacagaccgcatttacggcggcaccgcactgatcggtgcctacgtgtacggccccggcgatttcaacttcaccggcggagtacatgccaaggccatgaacctgtgtgcctacgcggatgatgtgactgacgaggtgcgcaaacacgagcaggcgctgtacgaggatttcgcaacggccacgctcaacccgaccatcgtggacaacttcatcggcatgtgcatggcgaaaatcgtattcaactcggtgctgaacacgttgtgtaccatgtaccagattcgtttcggcgaattccatgcgcatcccgacgcgcgttggctcaccgaacagctggtcgacgaagcctacagtgcggccgaagcagccggataccaactgttgggcacgcgcgaaacggaagtcgaaaccattctgcacaccgcgggcgtggcgcatccgctgcactatccgtccatgtatcaagacctgaccaagggacgtccaacggaagtcgactacatcaacggctatatcgccaaagtcggacgcgagcatggctacgaatgcaagctgcacgaattcctaacccgcgaagtgcatctcgccgaacaagccttcgccatccacaatccagacatcgtcgcacaggccaaagccgacgtcgaagccagtaagccggtaacggaataatcgtattttttcaaaacaagtaagagagggaaacaaccatgaccatcgctattttcaagaggccgaacggcatcaaacgaatcgccgcagcagtacttgccgctgcaacacttatttccgttgcggcatgcggttccggcaacagcgcatccgcatccaaggaaagcctgaacaccacgaagggcaaaaccaccacaatcaccgtcggcgtgtgcgcaggaccatacggcgacatggtcgacaaggttatcgcgccactgctgaaggatgacggtttcaaactgaagaccaagctgttcaacgattatgtgcagcccaataaggcacttgcatctggttccattcaggcgaatcttttccagcatggcaattatctgaagaagttcaccgccgacaacaatctcgacctgacctcccttggacagaccccaacccttggcttgggcatctattccaacaaatacaagtccatcgatgatatcgaagacggagctacggtcgcaatcgcgaacgatggctctaacctggcacgttctctcggcgtgctccagcagcagggtctggtgacgctcaagggcgaagtcgatgccaccaaggccacggtcaacgatatcgcatccaatccgaagaacctcaaaatcaaaacgatcgatgctgcacagctggcccgttccttggacaccgttgatgtggctctggtgccgggcaactactcttgggctgctgatctgaagcctgccgatgcgctcgccatggaaaagcaggatgatggcgtgatcgaagtgttcgtggtccgtacccaggacgtcgattccgacttcggcaaggccgtcaagaaactgctcgtcagtcagaaattcaaggacgccatcgccaagagcgagttcaaggatttcggcaagccgaccacttggtgaccgctgcagcgcggcgataggtaatatgcaaagacccgtatgaattgggaaactcatacgggctttatgcaaacgagattcatcaaacgaaacgtatcgaacgaaacgtatcgaacgaacgtaaacacgtacttgaacggaatgaggaacgaaccatgagcgttattgaactcaacgacgtgtccgtgacctttcatgaaggcggacgaaccgtcgaagcggtcaaacatgtgaacatcagcgtggaaaaaggcgaaatcttcggcatcgtgggcttctccggagcaggcaaatccacgttggtgcgcaccatcaacctgctggaacgaccgacgggcggtcatgtggtgatcgacggcagcgacatcaccgcactcaaaggcggtcagctgcgcgacctgcgcaagaaaatcggctttattttccaaggattcaacctgatcaccaatgtcacggtcggcaagaacatcgaattcgcgctgaaagccggcggatatccgaaagcgcaatggtcggcacgcatccgcgaactgctggcactggtcggtttggaaaacaaaatcgacagctacccgtcaagcctgtcgggcgggcaaaaacagcgtgtatccatcgcacgtgcgctcgccaacaagccggaaatcctgctgtgcgatgaagctaccagcgcacttgacctggaaaccacggaaggcattctggcgcttctgcaacgcatcaaccgcgaactgggcattaccatcgtgttcatcacgcatcagcttgacgtggcaaagcagattttcgaccgagtggccgttatggaaaacggtgtggtagtggagcaaggcaacaccttcgacgtgttcagcacgccgaagcatccgaccaccaaagcgttggtggaacgctatctgggcattgcggtgccgccgcagctggtgccgtcgctgccggccggcaccatcgtggaactgcgatacaagggggatgcggcactcgaaccgctcatcagccgggtcgcgcaggattacggcgtgagcatcgacgtgctgcatgcgaatgtggaatatttcggttcgcaggccatcggcattctgattgtgctcgtttctggcgcgggggagccgctggtgcaggcgttgaatacgttgagaacgcatgtgttcagctatcgggaacttgatcgtgggcagctggttgtggccgccgaagctgcggataatcaggaggcgtgagaacaatggaagaaactctggaaatccttcaagacaatctcggtcaggcgttgatcgacacggcatacatggttgtggtgtcggcgattatcggcgtggtgttgggcacgttggtggcgttgctgctgtatttgaccgaaaatcgtttgttcacgccgaatcatgcgttgaacgttattgtcggtttcatcgtcaacgcgattcgttcgctgccgttcctgattctcatggtggtgcttattccggttgcgcaattgattctgggtgatccttacacgccgacaggtggcgcaatttccctgtcgatcgccgcggtgccgttctttgcgcgaatcgcggaaagcgcgttttccgaagttgatccgggcttgcttgaagctgccatctccactggtgccaccacacgccaaatcattgtggatgcggtattccctcaggccttgccgtcgttcattcgtggtgtggtgctcaccattatttcactgattggctattccgcaatggtcggaacgatcggcgctggcggcatcggcgatatggccattcaatacggctataaccgttacgaaaccggcgtgctcgtcgtgattgttattattctgatcgtcattgtgcagatcattcaatgggtcggcgattggttcgcacgcaaggtgacgcactgatggttgcgtatatgcgtgaatgtgcgcatatacagtcgcacgatgatagggagggttgatgaatgacttcgtatgtttctcctgttgcgttcactacggtggcgcagtcgattccgccgaatgtgttcgccgatatggatcgcaaagtggctgccgcggttgcggacggggccgatgtgatcgatttggccaaaggcaatccggatgcgttccccgctgacttcattcgagaagtggccaaaaaggcggttgacgatccggccaatgcccggtattcgccgttcgacggcaaaccgagttttctgcaggctgccgaacagtggtatcgcaacacgtatggtgttgaggttgattggaaaacccagctttttgccgtggagggcgcggttgatggtctcgcggcgctgttcgccgtgcttgtttcgccgggcgatgctgtggcatatgcggatccgtattacccctcgtatcattgcatgacggtgatgagccgtgccgaggaggttctgctgccgtcgctgccggaacgtggcttcctgcctgatttggatgcggtgcctgcgcaagtgtggaatcgtgtgaaagtgctggtgctcaactatccgaacaatccgacgggtgcgcaggctccgcgtgggtttctgcaacgtgccatcgatttggctcatgaatatcatttcgcgatcgtgcaggatttcgcttatgcgggattgggagtcgatgcgcagcaaatcagcatactgtcgctgccgggtgccttcgatgttgcggtggaagtatgctcgctgtcgaaaatgtatgcgatggccggctggcgtgccggtttcatcgcgggcaacgacgacattgtgtctcatgtgaagcagtaccactatcaaatgggttccatggttacgtccagcattcaagacgcgggcactgtggcactgctgtcggatcagagctgtgtggccgaacttgcggaacggtatgcgtctcgtcgcgaaatcgtggcaggtggattgcgtgaagtcggacttgatgttttcgattcagacggtggcatctacgcttgggtgcatgctcctgaagatcagacgggtgaacagtttgccgacatgctgttggaacgtgcggccgtcgccgcgctgccgggcatgtgttttggcaaagtgggcaaggattacgtacgattcagcctgcttaaatccgaggaccagttgcgtgaggctgtgcgccgggtggctgctgtgctagcgtaatttttcctacgtagcctttttgcatggatgagcgattgtgtgcttgcacaatcgctttttctattttcctccgattgtttgcgatcgtctttcgatcggttgtggacgtcccatcctccaattgccatcgaaacgtctttcccttaggaaaccgacacacgctccttatgcaggcgacgtttttgcgattgcggtgcggtgtcttgcatctccgccgtttgatagctgcttacaggaaaatgttatggcgattcgcgcgttctatagccaacgttgataaggtgcggcgcgcgttgaaatgcaggatgcggtttagtgggtaccagcgaccgcgtgaatggcacgcggcaatgaaccacaacccaagggggtgcacatcatgaccagattcaacactcagtttgtccacggactgccggtcaacgataacaacaccggagccgtgaacccgccgactacgaagcgcttgatgccgctgtttccgggcactccgccaagggacccgcgcatggttgtccggcgaaggccgtgtatttcgaagttcttaccaatccgttgctgcaggtcaacaatgtgacgaagattgctgaaatcgctcatcgctatggtgcgatttccattgtcgacaacacattcgttaccccgtatctgcagctgccgctcgaccaaggtgccgacatcgtcatccattccgctaccaagtatctggccggccattccgaagtcaacgccggtcttgtggtggtcaaggacgacgggttgggcaaacgtgtctacttcgcgcagaatcgtttgggtggcgtgcttgcgccgaacgaatgcgattcggtgcgtcgtggtattcagacgctcgccctgcgcatggaccgccagcaggagaacgcgcgtgcgatctccagctatctgttgctgcatccgctggtaaaatccgtgcattatccgggattgtcggggcatgagtatgagatttggacattgttcaggaagttgcggatgaggtgacggtaatgaaagacggccatcttgtcgaatatggagctgtcggttccgtgttacgacaccctaaagatgcgtatacgaagatgttgcttgaggcatcgcctaaatttgatgagattaatgcctcgtaaggagtgattttatgattgacaatgcggcaattgatttctatggagccgactggtgcggcgactgccatcgagccaaggcagcattagaccgtttcggggtcgcctacagccttcatgatatcgagcatgaggatggtgctgcagagaaggccattgcgatcagcggacaacagcacattcccgtgattcggttcgccgatggctcatggctggtggagccttcggccacgcagttgcaagccaaatgcaaggaactcggcctgatctgattcaacattgcgtatgccatctcacgagtcggacaaggagaattgtctcctgttcggctcgtagacgtatgtgggtcggcttccggacggtcgatgtccggcttccgaatggactttgcccaactcgcggacattgtctgcacgtgattgcattctttggtaagtttttgcttgggttcggcaatggttgcagaacctacggaaagccgtcaatcaacaggctttcgagagaaaaccaaagaagggagtaatgtcatgccgttccttattacgctccttgtcattgcacttatcgtcgcgttcctgttcctgtccacgttgtttatcgtgccgcagcagcaggcctatattattgagcgtttcggcaaattcaacaaggtgcagttcgccggcattcatattcgaatcccgttcgtggaccgtatcgccatgaaaaccaacatgcgcgtcaatcagcttaatgtgcagttggagaccaagacgcttgacaatgtgttcgtcacggtggtggcgtccactcagttccgtgttgacccgagcaatgtggccaccgcatactatgagctgcgtgatccggctggtcagctgcgttcctacatggaggatgcgctgcgttccgccattcctgcattgtctttggacgatgccttctcccgtaaggacgatgtggcctttgacgtacagaagaccgtcggcaacgaaatgtcccgcttcggtttcactgtggtcaagacgctgatcactgccatcgatccgagtccgcaggtcaagaacgccatggattccatcaacgctgcccagcgcgagaaggaggccacccgtcagcgcgccgaagcccagcgtattcagatcgagacccaggcggcagccgaggctgagaagacccgtcttcagggtgaaggccaggccaactatcgtcgtgagatcgccaatggtatcgtcgaccagatcaagagtctgcaggcagtcggcatgaacgtgaacgacgtgaacaatgtggtgttgttcaaccagtatctcgacaccatgcgtaatctcgcctcgtcgcagaatgcgaagacggtggtgttgccggcttcgacgcctggcggtttcaacgagatgcgcgaccagatcacccaggccatgatgtccgcggacgaagctgcgaaatagtcgcaaaatagtcgtgccgatgctctgcatcgatgacaagatgaccttcgtattcgtgttgtgcgaattcttgcgccaaagtgctttttccaacacgtcgtgctccctcaataagcatggcgcgcttgccattcgacgggcttttccaagctatgagtgtttgatatgccttgcgcctgaagagcatggtgtactccttgaaaattaaggcatttacacgaaatgcagagtaaggacagcgcgttttatacacgaaatgcagagtgtcgatacggggcgaggatgtttcgctgacgttccagaggcatgaagaatccctcctttcgagacggccgcttatatgtgacggagagcgcggcggtgaaaggagggattattgtttggcgcgttgccgtaccgcaacgcacgtctatgtgattggcctgtcggcaatgaccgtgttttgcgcacgcatgtcatacgtttcggcgtatgtcacgccatgctgacaagaccttccttggagtttgaattcggcagtgagcagttcatcgcatgtgattcaagcaggtgaagctgtttctgcaggtccatgactttcttttccagccatttgatggtcatggcttgggtgatcaccagcagatcgcgctgcccggaatcggatttgtttgccaacgtctgtgcttcaagcatgattttcggatcggctttccaacgggcgatcgcgcgttcgatgcgcttgcctcccatgattttcggatcaagacctgcgctggcgaaaatactggtaggaccgttgccgcgcagatattgcgccatgcaacgcacctgaaattccttcgagtacgtgatgcggtccatggaagctcgctccaccgcgggcagggtgttcaggtaatacacctcggtttgagtaaaacgacgacgcatgatggttccccttgtgtgatatgcggatgacgcttccgacaacgtcatccgaatgtctgcctcgttgttttcattctatttttgcgagattcggggattttgccgtctggcacgaaacgaagtgtttttggcacgaaacgagaaaaccaccctagttagggttgttttaggaggatgtgagacgggggtctgtgcttctcggggtattcccctaagggatgcagggaactggaaaacggtataaactcggttgtgggacagacgtattgacgccgtgtgggggagggcaacgaagactatgacagatcatgaagggcaagagtcgatggcggggacgcgcagacccatcatcgaagtcaagaatctgcgtaaggaatatccggtgctcgacgaaaccgtcgtggcgctggaacgcatcaatctcaccattccgcaagggcagatctgctgtatctacggcgaatccggttctggcaaatccactctgctgaaccagctagcaggcatggaaaaaccgaccaaaggcggcgtgcgcatcgggggagtgcccatttctcggttgaatgaacgacaattggcggaatttcggcaaaaacatcttggtttcgtattccagtcatacaacctgcttcccaatctgactgccgtggaaaacgtggcaatgccgctgatgttccaaggcatgccgaaaaacaagcgtgaggcaatcgccaagaaaatgctgaaacgagtagggctcggcaaacgcatgaaccactacccgacgcaaatgtcaggcggacagcaacagcgtgtcggcatcgcgcgagcgttcgcagccagaccgcaagtcgtattcgccgacgaaccgaccggcaacctcgactccaaaaccaaaaccgacgtgatgaacatgatctgcgcgttcgctcgcgacctcgaccaaaccatcgtgctcgtcacccacgatgacaatatggcgcaatatgccgaccgtatcgtaacgctacttgacggacgcatcatcgatgaccgtctgatgaacaacgcgtgacggcagagaagagaaggaaattccatgagtaacagcaaccattccgcaaaattcatcaacatgctcatcgcattgatggcgtccatcgccatcgcgctgacctgcattgtgccgacggcgctcgccgaagacggtgatggcactgacgacaacaacggcggctccaccgtgcagccggccggtccggtgccgaacatcatcatcaccaacttcacctatggcgacggttccgtggcggtcggcacgaatttcgatcttggcttcaccttccagaatatgggcaaggtcgcggtcagcaatatggtcgtgaccgttgacggcggcgagaatttcgccatttccggcggtacgaacacgttctattacgattcgctgtgggcgggctattccctgacccagaccgtgcccatgcaggtgctgtcgagtgcgaagaacggcgcgcagggcatcgatatcaacttcaaatacgagtatgtcgatggcggcacccgcaattccaacacttcggatatcaagatttccgtacctgtttcgcagcccgaccgtttcgaactgggcgatcccgtgcttccagacgccatcaatgcgggcgaggaatccaccatttccatggaatacgtgaacaagggcaagggggatgtatccaatgtcgaagcgtccatcgagggtgacggcatcaccgccacgcaagccacgcagtatatcggcaatgtggcgtccggcgcttctggttccatcggattcgctttcactgcggatgcggccggcgaatatgatgccaaactgaaagtgacgtacgaggatgccgacggccagcagcagaccaaggaatcgccggtgaagattacggtgtctgaggctccggctcccgccgatcccggtatggatgttgacccgcaggaaaatcaaggcattccgacttgggtgtggattgccgttgccgtggctgtcgttgccgtgatcgccattgtggttgtggtggttgtgcgtcgccgcaagaaggcgaagaaggctgccgaggatgacgattgggattgggatccctccgattcgcatgcaggtgctgatgatggtgcggctaatacggctggtgccattgacgcgccgacccaggtgattgattccgtgccctccgacaaggagtgagcatgcgattttcggatattgcacgttcatgcacgcagaatctgctgcgtcgcaaatcgcgtacgattcttacggtacttggcgtgatcgtcggctgctgttcgatcgtgctcatgatttccattggccaaggcatcaacgaacagaacgagcagatgctcaaaaacatgggcaacctgaacgacatcaccgtatatgcggacggcggaggttcacattccacggcaacgtcatccagcgtgagcggtgccgacggcgaacaggcgaaactcgacgatgacgccgtgcagaatttccgcagcattgccggtgtggctggagtgcttcctcagaaaacgatgtcatacagtgtggatgccacgcaaggagctggctcccggtacgtgtcgcaatatgtcaacgtggtgggagtcgacgccacgcaattggaagaatccggctataaattggccagcggacgtcttccgatgcgtgccggcgaagtgttggcgggcaaatccttcgtgtattcgttctacgacaagtatgcgtcagatccgagcaatcatcgtatagaagcgggcagttattactgcgatgagcacggttgcgcccaatccgaaggcgaagacccgttcttcgatatgctgaactccaaaatcacgttgattaccggagccaactatcaaagtcccgacgactaccgcaaggtgggcggcggatccgtggcgtcatccgattccggcagtggtgagagtcccaccattaccatgccatacacggtggtgggtgtcattgattcctccgccaacaactatgatgcgttcacttccggcattgtgatgagcatcgacgatatgaaaacgttgaacgccaaaatatcgggggacaccaaggccaacacgtcgagcaaggtcgtttacgatcaggtactggtgcacacccaagacatcaaagacgttgccgacgttgaagcgcaaatcaagggcgccggttatcagacttcctcgtttgagcaaacgcgtaaggagatcgaaaagcagtcgcggggcatccagttggctttgggcggcatcggcgcggtgtcgttcttcgttgccgcgattggtattgccaacaccatgattatgtcggtgtcggaacgtactcgcgaaatcggcattatgaaggctcttggctgctatgtgcgcgatattcgcatgatgttcctgtgcgaggctggtgcgatcggccttgtcggcggtgtgatcgcttgcttgatttccgcgattggttcgataggcatcaatatggcgtctttgggtggattcagcattgagaatatcggcaaagcgattatgggcggcgacgatgtgactcgcatttcggtgattccgtggtggctttttgtggtggccatgctgttttcgatcgccgttggtgtggtagcaggtttcggcccggccaataaggctgtgaagattcccgctttggatgccatcaagaatgatcagtgattgctgattacagatcgctgatttatagattggcggggaatggtccacagatataccgatcattcccgccaattcgcttatgtatcgattattcgctgagaataccgcggattcgagagacgatggtttctgaagtcaatccgtaacgttcgttaagctcgccaagaggcactcggtcggtgaactctttggctgcgccgaaattcagcacacgaacgtgagaagccttggtattactggaattggcataaaatgcggtgactttctcaccccatccgccttctagctggccatcttccaacgtaacaaccaaacgatgcccatcggcaagcatcgccagtaattcggcatccatcgtggaatattgcaatgcgtcaacaagcgttgcggtaatcgcagcatgttcttcatcattttcggccagtgccgacgtaatttcggcagccaacggcatggtgttgccgagtccaagaatcgccacatccctgccgggctgaacgatctgatagcgggcgaacgggcatgctccggcaatattgacggctggatcatgctcttcggcacgctgcaacgggtcgaacgccatatcggcggcacgttcaagtgcgagaatctgctcgccgggcatacgaatcgccactacgccatgtccggacgggccggtagcccaagccaacatgtcaagcatctgttcgccgctcgcgggagccaaacaggtcacgtcgggaacattggcgaacatcgtcatatcgaatgtgcccgaatgcgtattgtccgcgccggaaattcccgcgccgaaaatcagcagcgtggcgggaacatgattcaatgccaactcttgctgcagctggtcgaacgtgcgttggaagaacgtggcggaagtcgcaagcaccgggcgtccgccagccctggcgatacccgcggcgaatgcggcggcatgttcttccgtgataccggtatcgacgtagtgggcgccggcacgttcacgaaaatctcgggtgatgccattcgatccgggggttgcgggggagatgaccaccaatcccggctcattgtcgaaacgacgttccagcgatgccatggccatttcgccataatatttgcgtgcgtcgagcggtttgccgagcgaggcctccggattctgccaatggttggcctcgcattggcccgcatgaggttgaggattggtctgattgcagccatccgaaccattgtcggcttccgtttcgtcattgaagcccaagcctttggtggtgtggatatgcactacgatcgggtggtcaatgtctttgacctcgttcagtacttccaccagcgcgtcaacgtcattaccctgctccacatagcggtagtccaagccgaatgccttgaacagattcagttcggccatgccattcgacgtacgcaacttggcaagctgcccgtacataccgccgaaatcctcagcgatcgacatttcgttgtcgttgacgatgatgatgagattaccgccctgttcggccgcattgttcagcccctcgaacgcaatggccgaactcagggatccatcgccgataatggcgataacattgccgatagtgctttctccggcggcgccgcgctgcatatcgcgggttttggcaagaccgcaggccagagaaatcgaagtgccggtatggccgagcacaaaggaatcatgttcgctttccagcggattcgtgaaaccggtcacttcatcaaaacgagattggtccaagtatgcttcggcgcggccggtaagcattttgtgcacgtagctttggtgcgacacgtcgaaaatgaaacggtcgcggggcgagtcgaacacgcggtgcaatgccacagtgagctccaccacgccaagattcgagccgatatgcccgccatgttgtttgccgtagtcgagcagcgtggcgcggatttcgaggcatagatcgcgtaattgctgggctgaaagggcatgtacgtccgccggagtgtgaatcgaactcaaaatgccagcggtcatcgtgcgcaatcacccttccctacgatcagtgcaaccaagtgcgaaatcatatcccactgtatgccccgacgagggtgtttgcgggcaaaggagcgcaaagtcttctcaacttgaggcacaatagaggtgtttgcaatcgtgaaaagccgttattcgcaaaggagcgcgaacatgaaagccgtatatgccaccggaacgaattatgatgatccgctgtccgtgcttgaagtgggcactatgcctgagcctgaaaccaagccattctggtccaccattcgtgtgaactcggcgagcgtgaaccatcatgacgtgtggagtctgcaaggtgtggggctttccgacgagcagacgccgatgatcctcggcacggacgcggctggcgtgttggaagaagacattcccgtacgaaagggacttaaggccggttccgaagtggtcttgtataccttcgttggtaccgatggcgccggtgtgatgccgggggagagacgctcgatcctgtccgaacggtatgcgggaaccatggccgaatacacacaggtgcccagcgccaacgtgttcgccaagcccgcgaatctgaatcttgatgaggctgccgcattgggtaccagctggcttaccgcatattccctgctgttcgcatcggcgaatgtgaagccgggagacacggtgcttattcaaggcgccggaggcggcgtgtcgaccgcggcgattcagcttgctcacgcggccggattggaagtgttcgtcacgtcacgaagcgaagacaagcgtgcgcgagtgttgcagctcggtgccgatgcggcttttgaaacgggtgcgcgactgccacgcaaggcggatgccgtcattgaatccgtcggcgcggccacatggagtcattccgtcaaatccgtacgtccgggaggaactatcgccatttgcggcgcgactactggcgaccagccgggtgcagagcttacgagaatcttcttccaggatattcgagtgcagggcaataccatgggctcccgtgaggatttcgcacgtttgctgaaattcgtggaacatgccgatctgcatccggtcatcgattccgcatatgcgatcgacgacgcgcatcttgcgttctccaagatcgtgaatggcgacgttttcggaaaaatcgtgctgcacatctagccgattgcgtaaagtaaacggtgttcaagaacatgttcttttggattctttcggaggtccttgatggcagacaacaagcctgaagtcgcagtgattatggggtcggcgagcgattgggaaaccatgaagcatgcctgcgagatgcttgaccagttcgaagtgccgtacatgaagcaggtgatttccgcgcaccgcaccccggaattgatgggcgagttcgcgcatagtgcccgtgccaacggtctgaaggtcatcatcgccggagccggcggcgcggcacatctgccgggcatggtcgcggcccagaccaccctgccggtcatcggcgtgccggtgcgttcccatgcgctgtccggttgggattcgctgctgtccatcgtgcagatgccaggcggcatcccggtcgccaccaccgcagtcggcaactccggtgccacaaacgcaggtcttttggctgtgagcattctgagcaccaccgatgagcgtttggccaatgctttgcaggaatatcgtgactctctgaaggaaaaggtggctgaatccaatgcccagcttgtctgaggaaaccaatggccgtgttgaacgtctgatgccaggggccaccatcggcattatcggtggcggtcagcttggccgcatgatggcgttgtccgcccgctacatgggcttccgcatcggcgtgctcgacccgactccggattgcccgaccgcacaggtggccgacttccaagtcactgccgaatacgacgacatcaccgcgatccgagaactggctgaaaagtccgacgtgctcacgtacgagttcgaaaacgtgaacgccgacgccatcgacgaagtgcgttccttgtctgcagccccgcaaggcaccgatttgctgcgtgtcacgcaggatcgcgtcaacgagaagcagttcatcaacgatcatggcacgccgaccgcaccatggaaggccgtcaacagcgttgaggagcttgatgcggcgctcggtgaaatccattacccggccgtgctgaaaacccgttccggcgggtacgacggccacggccagaccgtgctgaaatccgatgccgatctcgaaaaggtacgagcccgtgccgatcgcggtggcggattcccgccgagcattctcgaaggattcgtcgatttcgcattcgaagcgagcattctcgttgccggtaacggcaaggattatgtgaccttcccgatcgtgcgcaacgagcatcgtaacaatattctgcacatgaccatcgctccggccgaagtcagcgaagacgtggcgaaggaagcgcacgaacttgctttgcgtttggcgcaaggcttcgaactggccggcatcctcgctatcgaactcttcgttaccaaggatgagcgggttatcgtcaatgagcttgccccgcgcccgcataactccggtcattacaccatcgaagcgtgctcgttcgaccagttcgacgcgcatattcgaggcatcgccgggtggccgctcgaacagcccgaactgctcaagccggctgttatggtcaatgtgctcgggcagcatgtggcaccgacccgcgcgctgatcgccgagcatcccgaatggaatatgcacgactattgcaaggctgaagtgcgtcatgatcgcaagatggggcatatcaccgtgctgaccgacgacaccaggcaaactgtggcggatcttgaacggaccggctgctgggatgatttgaaataaaaccgatgacggcatgtttcgcgcgtcagcctttccctgaggggaggacggcgcgcgaagccatcaagaacggacatagattgacggacggacgcgtggagcgcaacaccaaacaaaaagaactgattcatgatgcgttgaaggcaaacgatgaattcatttccgcacaggatttgcatcgcaagctggaagacgaaggcgtgaaggtcggccttgccactgtatatcgtcaattgaatgccttggctgaggcaggcgaggctgataccgtgcgtttggaaggccaacagctgttccgtctgtgtggtgatgacgggcatcaccatcatctcgtatgcacgaattgcggcaaaaccgtggaaatcgaatcgccatccgaaacttggctgcgtggcatcagcgagaaatacggattcaccatcgaacggcatacgcttgaggtgttcggactatgccccgactgccggaatgaggcacgacggtaattccgtcgatctcaacaatttcgccgatttcagcaacaacggttatgtggacggcggaatccttgacgacaactagatactgccatccgaactgtctatacccccctcatcgttcttttgcgatttcatcgacatatgcgtaagaaaatcagaagaaactgtggatgaaatcgatcattacagctttttgtcagatatggtcgcgagaatagtgccttggcgtcgccgtaaggcgggaaacgaagcgaactgacacgttacgagtggagataaacacttgacgaacgaatccgtgaatacagagacgattgaggaactgaagatctcgacgattgatccaaacgtacccgccaaggaacgtaaggaattcccagggtggttgtacggcatactgtttgtggtgttcgacgccatcggtgtggcagcgctacagattggcgtcagtcaatccgctacacgcgtcaagctttcgaacaacatgtggctgaccggttggggcttcgtcaccaaaatgttcaccaacctcaactttgtggcggtgctcaacctgattttgtggggcgtgctgtatgtgatactgctcatgctcatcaaccgcttctggatcgccacgccaatatttctggcggtgacattcattatcgcggtgatcgaacatttcaaagtatccatccgatatgaggcgattcttcccagcgatctgaacttcctcaaagccgatgcgggcaatcttatgagcttcatgccggcaggcgcacagtggaccattctgctcgccgtcgtcatattcgttgctttcattgcgcttttcgtattcctgaatcatcgtgacggccgtcacggcaagcttttccgtggcgacgacaagcagtcgcgctcgctgaatgccatcgtgcgactactgctgatcatcgtgccgggaacgttcttcacgctgtattccatgcaggtgagcactgtcggatcttgggcgaaaaccttctcttcggcaatgggggacatgccgtccatgtgggattccgtctacgatgcgcagcgcaacggaccgatggtcgccttcaccaggcagctgaatccgaaagtcatggtgaagcctgacgactattccgaagaaaccatgaaggaagtcgcggcacgatacgaaaaagaagcgaagaagatcaacgcatctcgtaccgagaacatgaccgacagtacggtgatctatgtgctgtccgaatccttctccgacccgtctcgcgtgccggggcttaagatcaacaaggattccatgcccaacattcgttccatcaaagagaatacgacctccggtttgatgctctcttccggatatggcggtggtaccgcaaacctcgaatacatgggattgacgggtttgagcatgtcgaatttcgattcgtcgctcaccagcccgtatcagcagcttgtgccgagcgagcattggacgccgaccatcaaccagctgtggggggcgtcgaagaattccatcggactgcacccgtacgaatcgtctatgtactcgcgtgcgaccaactataagaagttcggattctcgcatttctacacgttgaccggtccggacgtcatctcgcatcaagacaagatcgacgattcgccgtacgtgtctgacgaagcgacgtacgagagcaccatcgaagaagtcaagaaaaccgatggcaaccagttcctgcaggtcatcaccatgcagaaccacatgccataccacgattggtataagaacaacgatttcaaggccgaatccactacggacactcctttggaggacgatgagaaggagtccatcgaaacctatcagaagggtgcggctctgaccgacgaagcgaccgccgacttccttgacaagctcgacgccatcgacaagccgatcaccgtggtgttctacggcgatcatctgccgggcatttattcgtccgcttccgaagacgacaacaattcgcttgccttgcatctgacggattatttcatctggtccaacaaggcgtccagctcgcaaggcaacgagatcgacaacgccgactattcgtcgccgaacttcttcgtggcgcaggccgccgagcatatgaacgccaaggtgtccccgtatctggcgttcctcacgcaaatgcatgagaaaatctccgccatggagccacctgtcgtcaacaatatccagggatgggaccgtatccctgaaggtcagaacatctatctcgacgctgacggcaatcccatggccgaaagcgacttcgacgcggaaacccagcagttgcttgccgactaccagctgattcagtacgatatcaccacagggaagaactacctgaaagacaccgatttcatggatcttccctagaggcaagggggaagagatggccgcaaccgatcgcgaacagcagattttggcgtggattaagcagaatcctttgatcagccaaaacgagcttgcggaactgtgcggcatcacccgttcaggggtggccgcgcacatctccaacctgataaaaaaagggtacatccaaggcaaagggtatatcgtcactccgcccagctatgtggctgttgttggcgccatcaatatagaccattacggtgtcgccatgcaggatgtggttggggaaagttccaacatggggcgcattgtgtcatccgtgggcggcattggttacaatatcgcctacaatctgaaccggcttggcgtgccgaattatttgatttccgtctatggtgatgatgagaacggtgaacgtgtcaagcaggacgcgtatgccaacggcattgacatcacgcatgccaagcagatttcccatatgcctacttccaccttcttgtcggttgtttccgcgcaggggcgtcagattgtgggtcttgatgatatgcagatcagtgcggaaatcaccccggaatttctagcgcaacgagagcagaccatcgtcaatgcggaaatggtggcgattgattcgagcttgccgtctgatgccatagcatgggtttgcgaaaaaacaagtcgaccgattttcgtgtgcgtggtttccgttaataaagcggcgcgaatcacgccggtgctcgatcgcatcgacactatggtgcttaattccgccgaagccaaattcgtgtcggggattgaggtgcatgacgaggccagtgccagagattgcgccgaacatttgctgcggtccggtgtgcgtaatgtgtttctttttgtggatgattcggacatgctgtactgctgcgaacatgaaagctttttctggtctttgccgggaagggcggaggaacgtcgatataccaatggtggtgcgtcggcggcgttgagtgcgctggtgtgggcgcgtcgtgagcataaaacacagcgggaatgcgctagatatgcgtctgcggcggctgcgatgaatatgtctcaggtgcagtcgatttgcgctgatttttctgaagaagctgtgcggcgcaaagctgatttgctgcagtaacgcaggtatggcggtcttacatttgtttctttcgtaatcgcgagacacgcgatttttccatatgttacatcgatgaaaaataagcaaaagttgactggcttaaacttttgttgtactctaaattgaagataaaacgtttcatcaagggtgtatcaaggcagatatatccccgaaaatgtaggaggcaatatccatggcggatatgacttcaggaaatactgttcctgaccgttacgttgtggtcatcggtggcatgaacatggacatctgtggtagaccgacgagcaccgtagtggaccgagactcgaatccgggcgtcgtcagcatgtccgcaggtggtgtcgggcagaacatcgcacagaacatggctcatctgggcatgccgacatacctgatcaccgtctacggcgacgatgaaaacggcaagaccctggaacgttcgtgcgcggccaacaacatcaatcttgactatgccgcacagctggaaggacgccgttcttccacctacatgttcatcaccgacgatacgggcgatctgctggtggccgtcaacgacatggaaatctgcaaggaaatcaatccggcattcctcgaatctcgcctcgacttcatcaacggtgccgccatctgcctgcttgacgccaatcttgaaccggaaaccatggcatggattggcgaacacgtcaccgcgccactgttcggagacaccgtttccacagtcaaagcgcaccgtttcgacacgatcctcaacaagatgaccgtgctcaagccgaatgatttggaagcatccgtactcaccggcatcggtatcgccgaccagtattcggcaggtgccgcagcgaagaccttgctcgacaggggcgtgaagaacgtattcatttcattgggtgccaacggaatcctgtgcgcgagacacgaaaacgacgaatacagcttcaagcatgtgccgccataccgtaccgaaatcgccacggcaaatggggccggagatgccggcatggcagccatcacctggagcttcttcgataaccccgatcgagatcttgaagaagtcggcaaaattgcgcaggcagcatccagcatcgcgctcgaatgcacaaaagcagtgcccgatatcaccgtggaacgcatacgtaagaagatgtccggcgagatcgagccgttgctcgacgaagtgcgtaccgcctgaattttgctacatcacacgtccatcaacccatacaaacacaaggagaaccgacaatggtagtcaagcagatctattctctgatcgaatacgatgaggccgtcaaaaccatggaggctggtgccgataacattggactggtgccgatgcagcatggtggcgttccggcacatcgcgtgccaatcgaacgcgtgcaccgcattttcgacgaatgcaagcgtcgtggcgtcacctccgtggccatcatgctgaccaacgatcccgacgagatgatcgagcttgccagagaggtgcggcctgacattctgcatatcgcaggcgatgggtacgccgcagatgaagcattcgcggcccgacttaaggaagccgctccgaacaccaaactcatgcaggccgtgctcgttgacgatgaatccgccgtcgaccgtgccaagaagtacgcacaatactgcgatctcatcctcacggactccggtctggcccccgacaccggcattggtgccagcggtctgacccacgactggagcattgacgcccgtattgtggccgaatgcggcaagccggtcatcatggctggcggtcttggaccagacaatgttgccgaagccatcgaacagtgcaagccgtatggcgtggactccctgacgaagaccagcatcaaatacgacggcggctacatggagaaagacatcgacaaggttcgtcaattctgcatcaatgccgacgctgcggccgcaaagatcggacagtgaccgatggctatggaagtcaaactgctgcaacccgtcaaagtggtctgcactgacgatttaggggagactctggtcgatatcatgcagaccgcgggctattctcgtccgctgatggtcacggattccttcgtcggaagcatgccgctggtcgttgccgcacgtaccaagcttgaacaggtcggtgtcgatgtggcggtattcgaccaggtcaagcccgacccgctttgcgaaaccgtggaatccggcgtcgaagcattcgaagcgcataaggctgacagcatcatcgccatcggcggtggcagttccatggatgttgcccgaggcatcaacatcgtgcgtgtcaacggcggatccatcatcgaatacaccgatccagccaagccgatcgcaccatgcaacggtatgatcgcagttccgaccaccgccggcaccggcagcgaaatgtccaacgcgctggtggtcaccgaaggatccaccggtcgtaaactcgcggtgcttgccgatccggcagtcagcgaatatgccgtgctgaacgcggatctcatgctgacactgcccgcaaaaatgaccatcgcttgcggacttgacgcattctgccacgccgcggaaggatacctttcccgaatggcaagtccggtcacggatgccatttgcgaaaaagcgatgttcctgctgtacaactatctgccgcgtgctgtggcaaacggtcaggatcgtgaagccagggaacgtgtgatggtcgcgtcgacgcttgcaggatggatgctgaacaatgcgggaaccattgcggggcattccatcgcacacgtgctcggagcgaaataccacatcgtgcacggtgaagccgttggctacgcgttgccggcggttatggagttcgttgctcccgtacgtgcgcataaggttcgtgagatcggtcagattctaggtgcggtctacccggaaaatgcgccggacgagcaggttgcgattatcgcaagcagagcgttcaaggatttccgcgaccgcatgctcggtctgcatcctgttgaggattacggcatcagcgttgaagaactcgtttccaatgcgcaggccgtagttgacgagcgttttgcaggaaacacacctcgtgacatcgatcttcaggcagccgaacaactgctcgaaggtttcggaagtcgctgatatcaaaggccattgccggccttgcaacaagttgtgtgaccgatgagccggagtcagtcaatcgtcgaccacctcattatcggttcaaagttggagcacataaggaggaaccataatgtccaagaaaatcatccttgattgcgatccgggacatgatgacgccgtcgccatcctgcttgccgtgggcaatcccaatatcgatctgctgggcgtcaccacggtaggtggcaatcagagccttgacaaggtgacctacaacgcccgtgcagtgctggaaaaggcgcatgccaccgacgtgccggtgcatgccggatgtgaccgtccgctggtgcgcaagcaggaagtggcagcttccattcacggcgaaaccggtcttgacggcgttgaactgcctgaacccagccgtccgctggaagccggacatgccgtcaactggattatcgacaccattatgagcaacgagccaggcaccatcactctggtgccgaccggaccgctgaccaacattgccatggctgcccgcatggagccgcgcattgttgaacgtgtcaaggaagtcgtgcttatgggcggcggataccatgtgggcaactggagtgccgtggccgagttcaacatcaaggtcgatccggaagccgctcacatcgtgttcaatgaagcctggccgatcaccatggtcggattggatctgacgcatcaggcattgtgcacgcccgaagtgcagcagcgtatcgaaggcgttggcactgatctcgccaagttcgtgtctggtctgatggacttcttccgcaagacctatcaagacaatcaagatttcatcgatcctccggtccatgatccgtgcacggtggcatacctcattgatccgagcgtcatgaccacccgtcgttgcccggttgatgtcgaaatccatggagatctcacacttggcatgaccgtcgccgacctgcgaggtccagagccgagcgccgaagaatgccacacccaggttgcagtcaagcttgatttcaacaaattctgggatttggtaaccgacgcaatcaagaccatcggctgaaagaagagaaagataagtaaaggggtgctctaatgacagagaccaaaaacagcaaaatgctcgacgaaggcggcaagtccgtcgtcgcattgatggcagcattgatggcagccatcttcgcgttccagctcaacgcgtccatgctttcgcctgcattgacgaccatgcgtgttgaactcaacaccaccgatgcgcagattggcttgacccagacggtgttcttcacctcgtgcgcagtgttctcgctgttcctgccgcgactcggcgatttgatcggtcgcaagaaagtgctgcttggcattcttgtgcttaccgctttgggctgcgtggtttccgcgctcgcggtcaacgtgccgatgctgatgatcggtcgtgtgattcagggtgttgccggtccgattgtgccgatgacgctgatcatgctgcacgccaaggttactgaagataagaagtacgccaagctcatggctattctgacttccgttaatggtggcatcggcggtgtcgacgctattcttggcggctggcttgctggcacgttcggtttccgttccgtgttctgggtcatggttggcgttgcggtgcttgccattgtgcttgtgttcgtgtatgcggaagaatccaccgcttccgagactccgaagatggattgggttggcgtggtttcccttgccgccgcattcttggccgcatatctggccatcaacgagattcagaagctgggctccgccaattgggcgctggtcgctgtcgaaatcgttattgcagccgtgctgttcgtggtgttctggaatgttgagaagcgtcagaaggctccgatggtcaccacgcattatctcaagcagcgtcgtacttggggtctgctgctgaccaccctgcttaccatgaccggcgtgttcgccatcatgaacggtatcgtgcctgctctcgctcaggataccgaagtcggcgccggcatgagcgccagcgtggtatcgttcgccaccctgactccgtatgcgttgatcggtctcgcattcggtccggtcgcaggcgtgctcgcttcgaagttcggctaccgtgcggtgctgcgtactggcttgatcgtctctgttgtgggcgtgctgttcggcatcttcgtgtgcaacgttccgagcatctgggcacttgtggtcatgtctttggctttgggtgtttcctacgcaggtactgccaacatcatgctgaacggtctgggcatcgtgctctctccggaagacaatccgggctacctgcctggtctgaactccggtgcattcaacctgggtgccggtctgagttatgcagtgctgtacgctgctcagaacgcgttcaccgcatccggcggtgcgaccagcggctacatcgcagccatggttggcggtgtgattctgctcggcctcgcgttctgcgcatccctgctcattccgaagccgggagagcagaagtaatcaatataagcttgcctgtgttgtgtgattaaaaaacggcggttttgcagtcggactcctctctgtccgaccacaaaaccgccgtcctttttatatatatgattgcgattgtatggttacagacatttctgatggtatgcaatcgctgggtgcattcagatgttcagtgccttggcgccgatgtcgtgacggtagaacatgcccttggtgtcgagctggtcgataatcgcatacaccttgtcttgagcggccttgatgtcggctgcggaggtttccaccaacagcacgcggccggaattggcgaccagaccttcttcgctacgagccacgccagcgtaatagacgtgggaatcctcatcgactggaatctcaggaatcgcagcgcccttgatcacatcgacagggtagccgtcggcggcgagcaccacaccaagcgtggcgttgtcattatcccaagtgaactccggagtctcgccattgagcagagcgctgatgccggcgccgagatcagacgtgagcttcggcagcacgacttccgtttccggatcgccgaaacgagcattgaactcgataaccttcggaccatccgcggtggcgatcaagccagcgtacagaatgcccgtgaacggcgtaccctcatcggacatagcctgcacggtcggcttcacaatggtttcgatagcggtgtcaaccacatcctgaccgatctgcggaacgggactgtacgcacccatgccaccggtgttcggacccttatcgccatcataagcgcgcttatgatcctgagaaatcggcatcggccagaaatcggtgccattcacaaaactcatcagcgagaactcctgaccctccaagaagtcctcgatgacaaccttcgcaccggcgttgccgaaacgatgatcgacgaaaatgtcttcaagagcggcaatggcggtttcctcatccatggcaacggtcacacccttgccagcggccagaccatcagccttgatcacaatcggagcgccatgttcacgcacataagcggtggaacgatccaaatcgtcgaacgtctgatacttcgcagtcggaatgctgtgacgctccatcaactgcttggcgaaatccttggaaccctcgatttgcgcggcggccttgctcggaccaaacgccttgatgccagctcccgcgaaatcgtcgacgatgccctcgataagcggcacttccggaccgacgaacacccagtcgtagccgttgttcttcacgaaatcaatcagcgcggcatgattggacgggttgatctgcgtggtgcggatgccgtcaagctccatgcctggattgcccggagccaccgtgacttcgctgacgctgccgccgcgcataagtgcatgggcgatggcatgctcgcgtgcaccggaaccgatgaccagaaccttcatgtttcctcctgttgtgtcccttttgggaaaatcctatgttcaggaaagtctttggaaataaaagggggtggccgttatggctcacccccgtatatgtatttactgcagttcgacgtcgctatcggtcttcttgacgatattgccgagtacgtaaccggcttcgtcattggacttgagcaattccatggtcttatcggcatcttcggcgttgaccgccaacaccatgccaatacccatgttgaagatgttgaacatttccatatggtcgacttcgccggccttttcgagcacgtcgaaaatcggcagtaccggccaggagccgaggttgatgtgtgcggccagaccgtccggaatcatacgcggaacgttttcgatgaagccgccgccggtgatgtgggcgacacccttgaccacgccggccttgaacagcggggagagggccttcacataaatcttcgtcggggtgaggagcacgtcgccgagcttttcgccgtcgagctcgtcaagcacggtatcgacggtatagccagccttctcgaacagggccttgcgcaccagagagaagccgttggaatgtacgccggtggacggcagaccaatgagcacatcgccctcagcgatggtggagccgtccacgattgcggacttctcggcaacaccgaccgcgaaaccggccaaatcgtactcgtcttcgtcatacatacccggcatttcagcggtttcgccaccgatcagaccggaaccagcctgtacgcagccgtcggcaacgccagccacaacctgctcgagcagtgctggatcgttcttgccgcaggcgatgtaatccaggaagaacaacggttccgcaccctgagcggcaatatcgttgacgcacatggccacgcagtcgatgccgatggtgttgtgcttgttggccatcttggcaacgaccagcttggtgccgacgccgtcagtgccggaaatcagcaccggctccttgtatccgagggaagccagatcgaacaggccgccgaagccgccgataccgccgaccacgcccggacggttggtgcgcgccacatgggacttgatgcgcttgacgacttcgtaaccggcttcgacgcttacgccggcttcctcatatgcttttggcatatcaaacctttctcgggttcagtgttcttcttgggatgaagtagtggtgtattcgttgccctcgtacttgcttttatacaaggcgaattcaggcagacgcacgcgatcttcaggagtaagggacttcaaaaaatcactttcataatcgtcgagtgcggtcgggtagtcgccattgaagtaggccacgcacagaccgccgtacggggcgtccgcacccaggccgatagattcgaccaatccgtcgagtgacaggaacgccaaggaatcggcgccaatgaaatcgcgaatttcttcaacggacttctttgcggcgatgagctccttggtggtggagatgtcgatgccgtagaagcacgggtacttcagcggcggcgagctgatacgcatgtgcacttcggcggcgccagcttccttcagcagctgcacgatgcgcttggacgtggtaccgcgcacgatggaatcgtcgataacgatcacgcgcttgcctttgaccacgccgcgcacggcggacagcttcatgcgcacgccctgctcgcgcagttcctgcgtcggctggatgaaggttcgagccacatactggttcttgatcaggcccatctcgtttggcagaccagcttcttccgcatagccggaggccgcggacagcgaggaattcggcacgccaatgaccatatcggcatcgaccggcgattcttgggccagacgcgcacccatacgcttgcgggcggaatgcacgtttacgccgtaaatgtcggaatcggggcgtgcgaagtagatgaattccatcgagcagatggccaactgggtctgattggtgtactgcacgatcttgtagccgtgatcgtcgataaccacgatttcgcccgggcgaatattgcgcaccaattcggcgccgacaacgtcaagcgcgcaggtttcggaagcgagcacataagcgccgtttttcatcttgccgagggaaagcgggcggaaaccgttcggatcaagcgcgccgatcatggcgtcttcggtcatgatcaggtaggcgaaaccgccatgcacggtgttgagcgcttccttgagcttgtccatgaacgtacgctgtgtggagcggcgcaacaggtgcatcaacacttcggtgtcggaattggagtggaagattgcgccttcgtcttccaactgacgcctcagagtcgggcagttcgtcagattgccattgtggcacaaggccatatcgccgtcatggaagcggaagatgaatggctggatgttgtcggtgccgcctgaaccggcagtggcgtaacgcacatggccgatcgccttgtctcccttcaggcgttcgatttcgcgttcgtcgccgaacacttgggtcaacagacccgttccgcgatgaccgatgagatgaccgttatcgttcgagacaatgccggcgccttcctgaccacgatgctgcagcgcgtgcaggccgaagtaggtgagtcgggcggcgtccgggtgaccccaaacgccaaaaataccgcattcctcgtggatgtcttcgagttcagctgacaagccaaagctccttccaaaaccatggagacaaggggttcgctaccgttcaaccctaccaaccggaggctacaattggcggttttcgtggagtccttagggacacttggcatgtcgggtgtgtcgaacaattgttcgaactctctgatatgctgaatgcaggaaaatacagtgcggtgcatcggcgatgctttgtcggtgctttgcgaggcgaagtgctcgttgacgtttcaagatggggccaaatcatggaaggagtctgaagatggccgaacgtacctatatcgctatcgatctgaaatccttctatgcgtcttcggaatgtgcggaactcggattcgaccctctatccacgcatctggtagtggccgaccaatcgcgcaccgacaaaaccatctgtcttgccgtgtcgccatcgctcaaagcatatggactgccggggcgggcgagactgttcgaagtcaaagcgaagcttaaagaagtcaatgctgcacggcgggcagcggcaccgggcggtgtgctgagaggtgaatcgtatgatgcgaaagcgctcgcagctaatccgaatctggctgccggcgtgtatatagcgaagcctcgaatgtcgcattatctcaacatcagtgcgaaaatctacagcatatatttaagatacgtatccgaagctgacattcatgtctattcgatagatgaagtattcatggatgttaccgggtatttgcgggcttacggcaaaagcgcgcatgatatggcccgtgaaatgatccagcagattcttcgggagacgggcatcaccgcaacggccggtatcggtacgaatatgtatttggcgaaagtggctatggacgtggtcgccaagcatattcccgcggataaggatggcgtgcgtatcgcgcaattggatgagatgtcgtatcgtcggctgttatgggcgcacaggccgttgactgatttctggcgtgtgggacgagggtatgcgaagaagctcgaagcccaaggtctaatgacaatgggcgatatagcccgatgttccataggccgtgccgacgagtattacaacgagggcctgctgtacaagatgttcggtgtgaacgccgagctgcttatcgaccatgcgtggggttgggaaccttgcacgatcgccgacatcaaagcgtataagccagctggtcatagtatgagttcggggcaggtgcttacgggcgcggtcggttttgactcggcgcggctgattgtgagagaaatggcggacaccttgtctttggacttggttgccaaaggtgtgaaggccggccatatggggttgatggtcggttacgataccgccagtcttgatccaaagcggctaggggtgtgtggcactccggaattgaaggcgatggctgagcgagccattgccgaatatagcggtcccgtaactcttgataggtatggtcggcgtgtgcccaagccggctatagggtcgattggtctgggcgaccatacgtcatccaccacgcgcatatgcgatgcggttgacgaattgttctgcagaatcgtcgatcatcggctgttggtacgtcgattgaatgtggttgcttctgatttgcaaacggtcgaacagctggctgagcggaatgctgcggcgaattacgttcagcccgatctgttttcggatatgcaggaagtctcaaatggaagcgatagcaacgattgcagtgataacgtcgataacaacgcgcggtcttcctatactgacgatatgcaggttgtcgctgagatttccgaacagcatgtgcaacagacgattcttgacatcaaacgcaagttcggcaaaaacgccgtcatcaaaggaatggacatgttcgctgatgccacaggtcaacagcgcaaccgacagattggaggtcatgcagcgtgagtttgcagcaaaccgaccgttacgatgacatcatcaacttgcctcatcatcgctcgcgcacgcgtccgcacatgagcatgcacaaccgtgccgcgcaattcatgcctttcgccgctctcaccggctacgacgacatcatcaaacaagccgccacccattccaacgaagcagtggaacgcgccaacacccccgtcaatctcgccgaaggctacctctccgcctaacatgcgtcggagaccaaaaaagaggctgtctggtttgattagggaggaatcccgatcaaaccagacagcctctgtatgttcgaatctacgtcagaacgcttttatggatgcggtcgtggatcaggcggcgaagtactccacgccggctgcgaacagcggctggtccttctcgccgggcacgttcttgaacgtaccgttgctgtaacgctcggagtggcccatcttgccgaacacgcggccgtccgggctggtgatgccttcgatggccagcagtgaaccgttcgggttcacgctcaggtccatgcccggcacgccggcctcgtccacgtactgcgtggcgatctggccattggccttgagctgggcgagcatatcgtcggaagccacgaaacggccttcgccgtgggagatggcgatggtgtgcatgtcgcccacctcggtctttgccagccacggggagagattcgacgccacgcgggtgcgcaccagacggctctggtggcggccgatggtgttgaacgtcagcgtcgggcattcggcggtcatcggcacgatgtcgccgtacggcaccaggccgagtttgatcagcgcctggaaaccattgcagataccgagcatcagaccatcacggttgttcaacaggtcacgcaccgcttcggtaacggcaggagcacggaagaacgcggtgatgaacttggcggaaccatccggctcgtcgccgccggagaagccgccggggatcatgatgatctggctcttcttgatttcctcaaccaaagctgcggtggactcagccacagcagcaggggtgaggttgttcacgatgagcgtgctcacgtcggcacccgcgcgctcgaaggcggctgcggaatcgtattcgcagttgttgccggggaacacggggatgatcacatgcggcttggcgacgccggcgccggtgtatacggtcttcttcggcgcattgaaggacacggtctcaacggtcttgcccttttcgtcgcccttggatcggtacgggaacacggattcgatgccgccctcccaagcgtcctgcagttcggccagatccagcgtctcaccggctgccacgaactggtaggcctcggtggtctcgccgacctcactgacctcaaccagattggatacggccggaaccttcgcggtgtcggcaagttcgatgatgaaggaaccataggccggggcgaacaggttgtccacgctgatgctatcggccagcttcacgccgatctggttgccgacagtcatcttgaagatagcctcggcggtggcaccgtagccaggcgtggacacggccagcgcatcgccgaaatcggtgagctcctcgactgcggagaacacctccagcagcgaatccttgtccggtgtgaggccgtcggcctggtaacgcggcgcgatgcggatcacacggtgaccagcgcccttgaactctggggaagtggcacgcttcatgttgcccacagccacggcgaaggagatcagggtcggcggaacgtccagctgttcgaacgtgccggacatggagtccttaccgccgattgcgccagcgcctagatcgacctgcgccatcagagcgcccagtacggcggccatcggcttgccccaacgctccggctcgtcgcgtagcttctcgaagtattcctggaagctcagatacgctttctcatgttcgaaaccggcggccaccagcttcgagagcgactcgaccacagacagataagcgcctgtgaactggttctgctccatgatgtacgggttgaagccccaagccatcgcggaggcggtggtggtctcgccgaacaccggcagcttggcgaccatggccatgttcggggtcagctgcttcctgccgccgaacggcatgagcacggtgcctgcgccgatggtggagtcgaaacgctcggaaagacccttgttggaagccacgttcagatcggtgagcatggcatgcatgcggtcagacaaggaaccggaagcccacggggtggcgtagccgtgctgcgcctcgacatgcaccacctgatgcttcggagcgccgttggaggcgaggaactcgcgggacagatccacgatcgtgtcgccgttccataccatcgtcatgcgcggctcttcggtcacggtcgcgatgacttcagcctcgagattctcttccttggcgtagccgaggaactcgtccacatcctcggcggccacgtccacggccatgcgctcctgagattcggaaatcgcaagttctgtgccgtccaggccttcgtacttcttcgaaaccttgttgagatcaacatacaggccgtcagccagctcgccgactgccacggatacgccaccggcgccgaaatcgttgcagcgcttgatcaggcggcatgcgtcaccgcggcggaacagacgctgcagcttacgttcgacgggagcattgcccttctgcacctcggcgccgtcaagctccagggattcgacgttatgcgccttggacgcgccggtggcgccgccgataccgtcacggccggtacgcccgccgagcaggatgaccttgtcgcccggagccggggtttcgcggcgtacatgatcggccggagtcgcggccacaaccgcaccgacctccatgcgcttggccacatatccggggtggtagatttcgtccacctgaccggtggccaggccgatctggttgccgtaggaggaataaccggcggcggcggtggtgacgagcttgcgctgagggagcttgccttcaagcgtctcggacaccggcacggtcggatcggcggcaccggtcacgcgcatggcctgatacacgtaggaacggccggaaagcgggtcgcggatgcagccgccgatgcaggttgccgcaccaccgaacggttcgatttccgtcgggtggttgtgggtttcgttcttgaacaggaacagccaatcctcatcatggccattcacatcaaccttcaccttgacggtgcaggcgttgatttcttcggattcgtcaagattcttcagaataccgttcttcttgagccacttcgcgccgatggtgcccatatccataaggcatacgggcttttcgtcgcggccaagctcgtgacgcatctcaagatacttatcgaacgcggcctgcacggtcgcgtcgtcaatctgcacatcatcaagttgcgtgccgaacgtggtgtgacggcaatgatcggaccaatacgtgtcgatcaccttgatttccgtgattgtcggatcacgctgttcctcggtgaagtgagcacggcagaactgcagatcagccaaatccatggccaggccacggtcggcgatgaactgctcaagatcggcgtcgctcatggtgcggaaaccttcgatgacctctaccttgcccggtaccggcacctgcgtcttcaacgtggtcttggtatccagcgaagcttcgcgagcctcgaccgggttgatcacataatgcttgatggcggcgatgtcggcgtcgctcagctcgccttcaagtgcatacaccttggcggaacgaacagtcgggcgctcgccctgggagatcagctgaatgcattcgctggcggaatccgcacgctggtcgaactggccgggcagatactccacagcaaacacattatcagaaccgaaatcaggcaaatcggcggaaacattatcgacctgcggctcactgaacacggtaggggtggcctgtgcgaacagttcctcgctaatgccttccacgtcataacgattgacgagacgcacattcttcagcgatgcgatgccaagaatggtcttcagctcgttggcgagctgcttggcctcgacatcaaaaccctgcttcttttccacgtacacgcgaaaaaccatggttgactccttgaaagaggggcttggtgagattgataaaaataagatttttaaaaacgatgaagcccgcatccgagtttgtactgcagatgcgggctatcgcaagtattattcggctacttcaatgccttcggacttggcgagttcagccaagcggctttcgacctcttcgtaagccggaatgatgtcgcccagatcgcggcggaacagatccttgtcgagatgctcgaccttgccggagccgtcacgctgatcccacagacggcaggaatcaggcgtaatctcatcggccagcagcagcgtgccatcggaagtgcgacccatttcgattttgaaatcaacaagcttgatgccgatcttggcgaagatctcgatcagggcttcgttgatgcggcgtgcgagaggtgcgatctcagccagatcctcacgggtgcagacgcccaatgcaaccagatcgtcgtcgttcacgaacggatcgtgcagatcatcgttcttcaggaagtactccagcaccggctccttgagcttgatgccctcttccacgtccaagcgagagcagaagtggccggcggcggtgttacgcagcacgatctcgagcgggaacatggtgaccttcttgaccagctgggaggtttcgcccacgcgggctaccagatggctgtcgataccacgcttcttgagcagatcgaagatcagcgtggtgatgaggttgttcagcctgcccttgccggcgaagtcttccttcttttcgccgtcacctgcggtagcggagttcttgtattcgacccagagcacctccggatcgtcagttgcgtacagttgcttggctttgccctcgtagagcttttccaacttctccattactcgcctttcctggtgtttgggaggtagatagtttggtgaacttgacggttaacaagataccaacgggaggctacaatcgaatggtttttgggcgcgttccggcagtcttccgtcagtatccggcaatagtgcgtcaggcgatgtcgatttcgagcgattcggccacattctcggctttagcacgcgcgtcggcctcatctgttccgatggccagcgcgactgccatgcgacgatggccgtgcacttccggcttcgcgaaaatacgcagatcggtgcccggctgagacaaagcggtggcgacgttgcggaattcggcttcaccatcgccctgaatgacgatcgcatggcttgccgcgacggcaccgtccgggatcgacaaggcgacatgttcctgcgtaatcggcaaaccgagaatcgcacgcgcatgcaacgcgaattcgcttaaccgttgcgacgccatcgtgaccatgccagtgtcatgcggacgtggggagacttcattgaacagcacggaaccgtcggtcagcacgaacagctccacgccgaacacaccccaacccttctcgccggaagccttggccttcgccaccagaccttccactgcggtgcacgctatgcgttgtgcctgcgcaagcacatcctgtgtgaaggaggccggttgccaggattcgcgatagtcgccgctttcctgacgctgtccgatcggagcgcaggtcacgatgccggcgctggagctgacggtcagcaccgtcagctcgtaatcaagcggagccaacgcttctacaatcactcgggaaacgtctccctcgtcgtgcgcgcgacgaccttcctgtgcctcaacccaagccgcatcaatcgcatcggcggaacgcaccacggactggccgtgaccggaagaactcataatcggcttgaccacgcacgggtagccaaccgtttttaccccagcgcgaagctcttccagcgagcctgcgaagcggtacggcgtggtcggcaatcccaattcctcatgcgcaagtacgcgcaaacgttcacgatccatgcaaatggatgcgatttcggcacttggcaccacctgtgcgccacgctcggccgcggcagccaattcgctggtggcgatcgcttcgacttccggcacgataatatccggctggatttcgtcaaacaatacgcgcaattgttcggcattggccatatcgagcgcacggtattcatgcgccacctgctgcgcgggggcaccctcataggaatcggccgcgcacacccatgcgccaagcctcatcagttcgagagtgacttccttgcccagctctccggagccaagaaacagaacacgagtcggatgcttaccaagcggagtgcccaaggcacgattctcttcagtcatgccttccattgtgccatcggcgtaggatggagtgcatgtctgagacggaacaggaagaaacacagcgccccctgaccatcgccatggtggtcgatacgtcgggaaaccgaggtaacggcacgtcgaattcggcgttgcagtgggcggaggaattgaagcggcaaggccatacggtcaggcttgtgggcattggtgcgcctgaatacccggcacgagtcaaccatgtgcctctggtcagttgggtggcgaaaaagcagcagatgcagttcgccgaaccgagcgacacgctgttcagaaccgcgttccgaggcgtggacgtggtgcacatctacacgccgttccgttttggccagcatgcgtgcaaagtcgccaaacagatgggaatcgcggttactgcgggctatcatgtgcagccggagaacatcacgtattcggcaggtccgctgaaatatattccgggcatcgacaagttcatctactggctgttcaatttgtggctgtaccgcaaaatcgaccatgtgcatgtgccgaccgagcttggcgcaagtttgctgcgttctcacgggtacaaatcgaaactgcatgtgatttccaacggatatgaatcacgattcactgcgaaaacgcagcgcgatgcggggaagtctgctccggttccgttccacattgtcgcttccggacgattgacgaacgaaaagaatcatgtcgcattaattcatgcgatcgcccgttgcaggcatgcgcaagatattgaactgacgattgccggcaccggtcctttgaaaaagaaattgcagcgactcgccgcacgtttgctttcccgaccggcatcgatcggatttcataagaacaccgaaatgcccgcgttgctgcgttccggcgatttgctggtgcatccttcgattgccgatctcgaatcggtgagcgtcattgaaggtatggccgccggtttggtgccggtcatcgcatcgtctccgttgagcgccgcaggccagttcgcgttacgtgacgaatcgctattccctgtcgacgatgtggaagcgttggcaaggcgcatcgattggtgggtcgatcaccccgatgaactgtcgaaatggggcgaaatctatgccgaacacactaaagagcattattcggtggctgcttccgtgcgtaaattcgtggctatggaacgcgaggcgatcgccgataatgccaataagcaaatcaatgcgtaacaatcagcataaatggaaccacatgcgtgataaatgatcgtaacgtaagcaaaaaggcgcgggatgtaattcctgcgcctttttgttgtttgtcgtaatgattatttttccgattgacagcgacgatgcgcgctacagcaatgcgatcagctgctccacctgctcatcggtggtggcccagctggtgcagatgcgcatcaccgtgtgcgtgtcgtcggccttttccatgaagccgaggcgcacattgcgctgcaaacgctcggatgtcgcgttgtcgagcgtgatgaagatctgattggtcggcgcgtcgaaggtgagcgtatagccacgttccaccagcacttcgcgaatacggtcggccgcatcgttggcgtggcgggcgatcctgcaatacagatcgtcggtgaacagcgtgtcgaactgcacgcccagcagccatcccttggcgagcagcgcgccatgttgcttgacgagcgtcacgaagtttttcggcatattgccgtgcgtgaacaccacggcctcaccgaacatggctccgaccttggtgccgccgatatagaatacgtccgcgatacgcgcgatgtcttcaagcgtcacgtcgttgccggttgcggtcagcgcgtagccaagtcgtgcgccgtcgatgaacaacggcatgtcgtacttcgtgcagaccttgcggatcgcctcaagttcggcgagcgtgtagagcgtgccgtattcggtggcctgcgaaatgtagacgcatccggggaacaccatgtgcgtgtagttgccgtccgcgtagaacgtggcgcagtactcgtcgagttcggtcgcatcgattttgccgtcatggtgggggagcgtcagcaccttgtgtccggtgaattcgatggcgcccgcctcatgcacgttcacatggcctgtgcttgccgcgattacgccggcatactgcggtgtgatggagtcgatgatggtctggttggtctgcgtgccacctaccaggaagaaaatctgtgcgtcagggcaggcgcatgcttcgcggattttggctttcgcgctttcgcagatgctgtcgttgccgtaacccggatattggttttgtgcgatttcgctgatgcgttcgatgatttccggtgttgccgtgcaggaatagtcgttttcaaaagacagcatgatgcgctccttgtatctgacctatgctgatgacttgcgaccggctgtttgctgtattcaagccgtccggatagcaaaaaacctcggaatttcttccgaggtctctaccggggtggctaacgcggctcgaacgcgcgaccttctgaaccacaatcagatgctctaccaactgagctatagccaccatgttttcgcttcatacagaagcgcaacagatgaaaactatacacgattttccagctatgtctacatcggcgtgttgcgtgtgcctgtcgtcggcttgcgctgtggactgttcattatgtgaacggcatattacgcaaggccgaaactcatgcgtaccttgtagtcgctgcatgcgtaagggtgtgctgtaatgacggtgtgggccgtctcggagtgttttcggcgtatgcggatcatcggccgaaaagctgtgaaatgtgaaggaagagagattcatgcagaaggtcaaagcgtttggtgattggctcaccaagtggttcaccgcgatcgtgatcgtgtgggccgtgttcaactatttcgtgccgcaggcaagcttgtggggcaaatcctataccggttatttcctgggtatcgtgctgttcggcatgggtcttaccttgacccttgacgatttcaagcgcattctcacccagcctctgatggtcatcgtcggtaccgtggcccacttcgtcatcatgccgttggtggctgtgctgctgtgctggattttccgtcttgatggtgcgctcgccgtcggtgtgattctggtcggctgctgcccgtccggaacctcgtccaacgtgatgagctatctgagccgtggcgatgtggcgctggacgtgtccatcggcattttgtccacgttgtgcgcgccgttcatgattccgctgttgatgcagtggctggcttcccagtatgtgtcggtcccggtggaatccctgttcctcaatgcggtcaaggtggtgctgttcccgatcgctcttggcgtgatctgccatgctattttcggcgagaagatcgagaagattacggtcgctctgccgatcgtgtcccaggtggccatcctgcttatcatcggcgtggtcgtcgcagccaacggtccgaagctgttcgtggcttcctcgctgcttgccatcccggtggtcattctgcacaacctgtgcggatacgcgttgggcttcggtttctccaaacttatgtacaaggtatatccgaagggcttccgttatgcacagcagaaagccatcaccttcgaggtcggcatgcaggattccgctttgggagcgactttggcgctgacgtcgttcgcttccaatccgttggccgcggtgccgtccacgttcttcagcgtttggcacaacatttccggttccgtgctgtccagctggtggcgtgagcatgatgacaggcatcagatccatcctgattccgacaatggcgagaagggctcggctgcgaaggcccgcgaagacgctgccgaaacagctaacagctgacattcgtcagtagattccgtcgtcatattgcgcattccctgaatctttcaaaacgattcagggaatgttttgttttgagtggtgcaaacgtgtcattgtgatgttttgttgctttgcgctgatgtaggcaaaatgattgaaattattgggatttaagggtgtcttcacccgtgttttttgttcgttttggggtatactgtaactgaaggccggagttgtggatcagtcgagaattcgtcaggtcgcaacgaagcgccgatggccgtgaggttcatgcgcaacgcctttaagatataactgaacaatagcgattcgaaacagcggcaatggggtagtacggcgcaggcgccgggccgcaaatgcaaaacagacaacgagactgaagagtgcgcgtaaggtagcgcgtagcaaagaagtgggaacctccttcccgagtggatggccccggattcgaaaggatccggggccattccttttgcgatttgcgacacggcatgttggaatgtcttgggaatccgtatactgataattcgtgtgtgccaacggcatgccttatgtgacaggcgtgcgggttgggatatcccggaactcgattgcatcacgcgcagcaatgcgacggtgagagagggatgggccatcgggccggtggactgtggctatcttcacgattcagatgcgtggagtgtgggtgcagtgcggcggtcacacaaaagcaagagaaaccactgaatcggagaattcaagttgcctactattgaacagctcgtccgtaagggacgtcaggcaaagccgaagaagtccaagactttggcactgaagggaagcccgctgcgccgcggcgtgtgcacccgtgtttacaccaccaccccgaagaagccgaactcggcactgcgtaaggtcgctcgtgtgcgcctgagctccggtgtggaagtcaccgcttacatcccgggcgaaggccacaacctgcaggagcactccattgtgctcgtgcgcggcggccgtgtcaaggatctgccgggtgttcgttaccacatcgttcgtggcgccctcgatacccagggtgtgaaggatcgcaagcagggtcgttccctgtacggagcaaagaaggcgaagtaagagatatgtcacgtaaaggaccttccaagaagcatcagctgctgccggatccgatttacggttccactgttgtggcacagctcatcaacaagattctgctcgacggcaagaagtcgatcgccgaagacatcgtctactccgctctcgatatggtcaaggaaaagaccgatcaggagccggtggcagtgcttaagcgcgctctcgacaacatccgtccgtccctcgaggttcgctcccgccgcgtcggtggcgctacctaccaggttccggtcgaagtgaagccggctcgtgcgaacaccctgtccctgcgctggctgaccgacttctcccgcgcccgtcgtgagaagaccatggctgagcgtctggccaacgaaatcctcgatgcctccaatggccttggtgcttctgtcaagcgtcgcgaggatactcataagatggcagaggccaacaaggccttcgctcattaccgctggtaattagtcgagaacgagagttaaggaacactcatggcactagacgtgctcaatgatctcaaccagatccgtaacatcggcatcatggctcacatcgatgccggtaagaccactaccaccgaacgtatcctgtactacaccggcaagaactacaagatcggcgagacccatgacggtgcctcgacgatggacttcatggctcaggagcaggaacgcggcatcaccatccagtccgctgcaaccacttgcttctggaaccgtcagacccatgacgagaagcagaagttccagatcaacatcatcgataccccgggccacgtggacttcacggccgaggtggagcgctccctgcgcgtgctcgatggtgccgttgccgtgttcgacggcaaggaaggtgtggagccgcagtccgagaccgtttggcgtcaggctgacaagtacggcgttccgcgtatctgcttcatcaacaagatggataagctcggcgctgacttctactactccgtcgataccatcaaaaccaagcttggcgcgaccccgcttgtcgtgcagctgccgatcggcgctgagaacgacttcgccggcgttgtcgatctgattcgtatgaaggcttatgtctggaacgacgtttccggcgacatgggcgctcactacgacaccaccgacatcccggccgacttgcaggacaaggctgagcagtatcgtgcagagctgatcgaccaggtcgcagagtccgacgaagagctgcttgagaagtatctcgagtccggcgaactgactgaggacgagattcgtagcggcatccgtaagctcaccatcaaccgtgaagcctacccggtgctctgcggctccgccttcaaggacaagggtgttcagccgatgctggacgccgttgtcgactacctgccaagcccggaggacgttccgtccatcgtcggtttcgatccgaaggacgaatccatcgagatcgatcgtaagccgaccaccgatgatccgttctctgccctggtcttcaagatctctacccacccgttctacggcaagctcgtgttcgtgcgcgtctactccggcgccgtcaccccgggcgacaccgtgcttgactccaccaagggcaagaaggaacgcgtcggtaagatcttccagatgcacgctgacaaggagaacccggtcgatgctgccgaagccggcaacatctacaccttcgtgggcctgaagaacatcaccaccggtgacaccctgtgcgacgaaaaggctccgatctccctcgaatccatgaccttcccggatccggtgatcgaggtggccgtggagccgaagaccaaggccgatcaggagaagatgagcatcgctttggcgaagctgtccgacgaagatccgaccttccaggtgaagaccgacgaagagtccggccagaccctgatctccggcatgggcgagctgcagctcgacatcatcgtcgaccgtatgcgtcgtgaattcaaggtggagtgcaacgtgggtaacccgcaggttgcataccgcgagacgattcgcaaggccgtcatgaaccaggaatacacgcacaagaagcagaccggtggttccggccagttcgcaaaggtcttgatgaacttcgagccgctcaacaccgaagaaggcgagacctacgagttcgtcaacgaggtcaccggcggccacatcaccaaggaattcattccttccatcgatgctggtgtgcaggaagccatggaatccggcgtgctcgccggcttcccggtggttggcgtcaaggctaccgtcaccgacggccaggtccacgacgtcgattcctccgaaatggccttcaagatcgcaggttccatgtgcttcaaggaagctgctccgaaggccaagccggtcatcctcgagccgatcatggccgtggaagtgcgtactccggaagagtacatgggcgacgtgatgggcgatatcaacgcccgtcgtggttccatccagtccatgaccgactccaccggtgtcaaggtcatcgacgccaaggttccgctgtccgagatgttcggctacattggcgaccttcgctctaagacccagggccgcgcaatgttcaccatgcagatggactcctacgctgaggttccgaagaacgtctccgaggagatcatcaaggcccagcgcggcgagtgacacgcgctgccgcttaagtggaaactgtctccagtcagcgctagtattttgtagcgctgactgggttcgggctccaaagtggcacaaacccgtcaaacccagtaaaatgtagcaagtgccttgaagtgagttcaaggcttactacgagacgtccaggaggacaaaacacatggcaaaggaaaagtacgagcgtactaagccgcacgttaacattggtaccatcggccacgtcgatcacggtaagactaccctgaccgcagccatctccaaggtcctgcacgaagagtacccggacatcaacccggcttacgacttcaaccagatcgacgccgctccggaagagcagcagcgtggtatcaccatcaacattgcccacatcgagtaccagaccgctgagcgtcactacgctcacgtcgactgcccgggccacgccgacttcgtgaagaacatgatcaccggcgctgcccagatggatggcgctatcctcgttgtggccgccaccgacggcccgatggctcagacccgcgagcacgtgctgctcgctcgtcaggtgggcgtgccgcgcatcctcgtcgctctgaacaagtgcgatatggtcgacgacgaagagctcatcgagctcgttgaggaagaggtccgtgacctcctcgacgagaacggcttcgatcgcgattgcccggtcatccacacctccgcttacggcgcgctgcatgacgacgctccggatcacgagaagtgggttgagtccgtcaaggaactcatgaaggctgtcgacgagtacatcccgaccccgactcacgatctggacaagccgttcctgatgccgatcgaagatgtgttcaccatctccggccgtggcaccgtggttaccggccgtgtcgagcgtggtaagctcccggtcaactccaacgtcgagatcgttggtatccgtccgacccagaccaccaccgtcacctccatcgagaccttccacaagcagatggacgagtgcgaggctggcgacaacaccggtctgctgctccgcggcatcaaccgtgaccaggtcgagcgtggccaggttctggctgctccgggctccgtgaccccgcacaccaagttcgagggcgaagtctacgtgctgaccaaggacgaaggcggccgtcactcgccgttcttctccaactaccgtccgcagttctacttccgtaccaccgacgtcaccggcgttatcaccctgccggaaggcgttgagatggtgcagccgggcgatcacgctaccttcggcgttgagctgatccagccgatcgctatggaagagggcctgaccttcgcagtgcgcgaaggcggccacaccgtcggctcgggccgtgtcaccaagatcatcgagtagtttctgcttgatgtcaaggcacgcttgaactagcgttttaggaaaacctcccgaggcacgttcgccaagggaggttttcctatatatggaaggcttcccgacaaagtatgcacaccgtggcataatgagcaaggctctttttaagctttccctgttagacgaagaaaataggtgagttaatttggcacagactaccaatgacatcaagaacggttccgtcctgaacctcgatggccagctgtgggccgtcatcaagttccagcacgtcaagccgggcaagggccctgctttcgtgcgcaccaccatcaagaacgtcctctcgggcaagattgtcgacaagactttcaatgccggcatgaagatggagttcgaaaccgtcgacaaccgcaacctccagtactcctacgaggacggcgacaacttcgtgttcatggatatgaccacctacgatcagatctacattccgaagactctcgtcggcgaccaggccaagttcctgctggaaggaactgactgcgtcgtgtccttccatgacggcaccccgctgtccgtcgaactgccggcttccgtgatcctgaccgtcacccataccgaaccgggtctgcagggtaaccgttccaacgccggtaccaagccggccaccgttgagactggtgccgagattcaggttccgctgttcatcggcgaaggcgagaaggtcaaggtgaacaccaccgacggctcctacctcggccgcgagaactgagagtaaggacgaaagaagtttcatggcacgttccaccgctcgtaagagggctctgaatacgttgtatgaagcggatgagaagggacaggacatcctgtcccttcttgctgagcgcattgagcagcccggcgcccagactccgctgcctgaatacgccatcgaaatcgttcgtggcgttgcggaacatatcgcagccatcgattctacgcttgacgagcattccaccggttggaaggtcaagcgtatgggcgttgtcgatcgcaatattctgcgtatcgcggcgtgggagatcatgttcaatgatgatgttccgaatatggtggccatcgacgaggcgcttggccttgccaagacgttgtgtgatgacgaatcaccggcattcatccacggtctgctcagcgccgtcagcgctgatgcggatgccgctcaagtggatgagcaaccgaccgaaccttcagctgaataaagctgaaagttaagcgattcggccgggtcgcgagtcctaaccggccgctatccttggtacgaataccttgactataagggggttttggtgaaccagtatgattccgaagccgtgatgtttgaccctcaagatgccgttctcgttctcgaagacggacaggtgtatgtgggtgaaccttacggcgcgatcggcacgaccagcggggagatcgttttcgcgaccggcatgaccggttatcaggagacgcttacggaccccagctacgatcgtcagatcgtggtacagacgttccctcatattggggacacgggaatcaatggggaggatccggaatccacgcgaatctgggttgccggctacgtcgtgcgcgatcccagcccgaacgtgagtaattggcgcgccaccggcagccttgatgacgatctggaagccaacaagattgttggcatcagccgtatcgacacccgcaagctggtgcgtcacctgcgttccgccggtgtgatgcgtgctgcgattttctccggtgacgccttgcttgacgacaatggcaagctgcgcaccatcgaatccatgctcgacgaggttaaatccactccgcagatgaaggggatgagcctctacgacgaggtcagcaccaaggaagcctacaccatcgaaccgtgtggtgaattcgcaggcaaggagccgctgttcaccatcgccgcggtcgatcttggcatcaaggccatgactccgcatcgtatggctgaacgcggttgccgtgtgcatgtggtgccttccagcatcacgttcaacgagcttgaagctctccatcctgatggtgttttcttctccaatggcccgggagatccggaacaggccgcccctgaggtgaacttgcttcgtcaggtgcttgatgcaggttatccgttcttcggcatctgcttcggcaaccagctgctcggacgtgcgcttggcttcggtacgtacaagctgaagttcggccaccgtggcatcaaccagccggtcaaagacatgactaccggcaaaatcgaaatcaccgcgcataaccacggtttcgccgtcgacgcgccgatcggcgaaaccgttgacgcgccgttcgaaaacggcaagtacggcaaggtgttcgtcagtcacatcgatctgaacgacaacgtggttgaaggcctgcagtgcgtcgatattccggcattctccgtgcagtaccatccggaggccgcagccggaccgcacgatgccgcatacctgttcgatcgtttcgtggatctcatgcgttccgccaaggagggaacccgcaatgcctaagcgcacagacatcaagtccgtgatggtcatcggctccggtccgattgtgatcggccaggccgcagaattcgattactcgggcactcaggcctgccgcgtgcttcgtgaggaaggcatccgagtcattctcgtcaactccaacccggccaccatcatgaccgatccggaaatggcggatgccacctatatcgagccgatctccacgccgatcctcgagcagatcatcgccaaggaacgtcctgacgccctgctgccgaccctaggcggtcagaccgcactgaacgcagccatggcactgggcgaggccggtgtgctcaagaagtacaacgtcgagctgatcggcgcttcccttgaagccatcgaccgtggtgaggatcgtgagctcttcaagaaggtcgttgaggaggctggtgccgaatccgcacgttccgatatcgcccattccctcgaagaggtcgataagatcgctgagaagttcggctatccgctggttgtgcgaccgagcttcaccatgggtggtcttggttccggcatcgcgcacgatgaagaggaactgcaccgcatcgcaggcgcgggcatccattattccccgaccgacgaggtgctgatcgaagaaggcatcgaaggctggaaggaatacgaactcgagctgatgcgcgacaagaaagacaatgtcgtggtcgtctgcccgattgagaacgtggatcctgttggtgtgcacaccggcgattccattaccgtggcgcctgtgttcacactgaccgatcgcgaatatcagaagcttcgtgatatcggcatcgccattattcgtggcgtgggcgtcgatactggcggctgcaacatccagttcgccatcaatccgaacaccggacgtatcatcgtcatcgaaatgaacccgcgtgtgtcccgttcctccgctctggcatccaaggcaaccggcttcccgatcgcgaagatcgccaccaagctggctcttggctacacgctcgacgaaatccagaacgatatcacgcagtccactccggccagcttcgagccgaccatcgactacgtggtcaccaaagtcccgcgtttcgctttcgaaaagttcccgggtgccgatccgacgctgaccacctccatgaagtccgtgggcgaggccatggcgctggcaggcaacttccaggaatccctcggcaaggccatgcgctccatcgacaagcgtcacatgagcttcagctgggatggcgacaagccttccgcacaggaagtcgatgagctgctggacgccatcaaggtgccgaccgagcatcgttatcttcagatccagcgtgccctgtggggaggcgccaccgaacagcagatcttcgacgccaccaagatcgacccatggttcattcgccagttcgaactcatcaatgagacagctcttgaaatcaagggagcggagaaacttagccgcaagctgctgaagaaggcgaagctggctggtctttccgatctgcagatcgcccacctgcgtcgcttgggagatgaaggcgaaaacacgatccgtgagcttcgttggtcgtatgatcttcgcccggtcttcaagacggtcgatacttgcgctgccgagttcgacgcggtgactccgtactactactcctgctatgcggatgaaagcgaactgcgcccgcgtgagcgcgaagccgtgatcattctcggctccggcccgaaccgtatcggtcagggtatcgagttcgactacacctgcgtgcatgccgtgcaggaactgggcaaggactatgacaccatcatggtcaactgcaacccggaaaccgtgtcgaccgattacgacatgtccgatcgcctgtacttcgaaccgctcaccttcgaagacgtgctcgaaatctacgaggccgaaaagaagatgggcccagtcaagggtgttatcgttcagcttggtggacagaccccgttgtctttggcagctcgtctgaaggctgctggcgtgccgattctcggcaccacgcctgaatccatcgatctggctgaaaaccgtgagctcttcggcgaagtgctgaagaaggccgagatgaacgcgcctcgctacggcaccgccctgagtcttgacgaagcccgtgaagcggcacacaacatcggttacccggtgctggtacgtccgagctacgtgcttggtggtcgtggcatggaaatcgtgtatgacgatgcccagttgcgcaagtacgtggaccgcgcattgaaggaagcccaggccgataccgtggtttctggccgtctgccttctccgctgctgatcgacaagttcctgcaggacgccgtggaaatcgacgttgatgccctgttcgacggtgaagagttgtatatcggcggcattatggagcatgtcgaggaagccggtgtgcactccggcgatgccgcatgcaccttgcctccgagcaccctttccgatgatcagatccgtcgcctgcgcgaaggcacctatgccatcgccaagggctgtggcgtgcaaggcctgatcaacgtgcagtacgccttcatggccaacaccctgtacgtcatcgaggcaaatccacgtgcttcccgtaccgtaccgttcgcttccaaggcgaccggcgtggcactggccaaggcggcggctcgcatcatggccggcgaaaccattcagcagcagcgcgacaacgacttgctgttgcctcacggcgatggtggagatattcgccgcggtcagcaggttgccgtcaaggaatccgtgcttccgttcaagcgtttccgcacaccgctcggcaagaccgtcgacgtgttgctcggaccggagatgcgttccaccggcgaggtcatgggctttgaccgtgacttcccgcatgcgttcgctaagagccagctggccgcctatgacggtggcttgccgacaagcggtaacgtgttcatctctgtgaacgacaccgacaagcgtcaactgccgttgtttgccgcacgcttggtggagcttggcttcaacatttgggccaccgagggtaccgcatccgtgttgcgtcgctatggcatcgactccaagatcgtcgataagatcagcgtgcgtatggattccgatccggatgatccgattaccacctaccatgcggaaggcagtgtcggcaagaatgtcgtacagctgatcgaagaaggtgccatcgatctgatcctcaacacgccgaactcccgtggatcccgttccgacggctatgccatccgttcggcggccattgccgcggatctgcctcagttcaccaccatgacggaattctccgctgtattgatggccatcgaggctgtgcgcaataatgattatcagatcatgagcattcaggatcattcccagcagctgttcgagttggaaagccgtgagtaatggtaagtagcctcagtagtgaagagatgaatgcccagcgttcggatttcggtctgcgtctgagcaattccatggccaagtatggtccgctgtgtgtgggcatcgacccgcatcggcaactccttactgactggggctacaatgtggacgccttaggtgcggaactgcactccatgcgtatgttgcaggcagccaatgggagagcggcagccgtcaaattccagttctccatgttcgagcgctacggttcgaaaggtatcgcggcgctcgaacgggtactgtatgcggcccgtcagatgggaatcatcaccattgtcgactgcctgcacggcggtctgccgactacggtgtccgcattcgccgacgcctatttcaagccgggatctcctctgctggccgacgccatcaccttgctgccgtactacggtgcacgttctttgggcggtgtgatcaacgacgcgctcaataacggtcgaggcgtgttcatcgcatcgttgacctcgaatcaagaaggtgccagcctgcagacagccattcgtcaggcgggcgaatacaagggtagaaccgtggcctacggcatcgccagcaccgcgcagaaattcaacaagggcaatgacggtatgggttctgttggcttgatcatcggtgccaccattggtcagtggatcaatgattccggtgtcgacccagctaagttcactggtcctattctgtctccgggctacggatggcaaggtgctgaaacccgcgacctcaagacggtattcaaaggcactaaaggcaatgtgcttgtcaccgtatctcgttttatcgccgcacacggcccggatattgccgctctgagcgcggccacggaatccgtggcgctcgatattcgtcaggcgcttatcgaagcgcagaacgaaatcgatgatgaggttttggacgacgacgaagaagagtgatcgcgcgttctcaaatccgatgctgagattccatattccatgttctgttgattgttatgaaaaatgaggatgtaatgactgattctcgtcatggacgtttgattgtgctttgtggtcccgccggtgttggcaagggcaccgttttgggacgcgtacgtgagcagcatccgcagatttggctgtcggtatccgcaacgacccgtaaaccacgtccaggcgaagtggatggcgtcaattacttcttcatgaccgaacaggagtttctcgccaaagaagatgccggtgagtttttggaaaccgctgacgtcttcggtcttgcccactacggcacgcccgtgaaaccagtcgtggaacatcttgaacagaatattccagtcattctagaaatcgacatccaaggtgcccgtagcgtcaaacagcgtgcgggggagttgggccttgatgtgatgactgtgttcattgcaccgccgtcattcgaggaattggagcgtcgtcttgtcgggcgtggtaccgaaaccccggaacagcaggcgaaacgtttggaaaccgcgaaaatcgagcttgccgctgaacttgaattcgacaaagtcatcgtcaataatgttgtcgatgatgctgcaaacgaactgtggaatcttattgcaacggaattcaatctgtagtcataataattaaagactgcaacatgcgttcgaatatatcgggcgcatgtttttttttaaaaaaaaagaggattgcgcagtaagtaaactacgcaatcctcattatgtattatttgagattcactgaaactcaggcgagaccggaaagcttgttgatcagctccggatcgcgcgtggcacccttatctgcggaacgcgcgaaggccgcgtaggccttcagcgcctgggagaccttgcggtcgcggtgtgccacatagccgtcaccggcttcgagttcggcgcggcgttgggtcagctcttcgtcggaaagctcgacgttcaccgtacggttcgggatatcgatgttaatgatgtcgccgttcttgataagggcgatcgggcccttgttcgctgcctcgggagcgatatggccgatggccagaccggaggagccgccggagtagcggccgtcggtcagcatggcgacctgcttgccgatacccttgcccttgacgaacgacgtcgggtacagcatctcctgcatgcccggaccgccctttgggccctcgtagcggatgaccagtgccataccgggcttcagggtgtcgttgaggataacctcgatggcctgttcctgggattcgacgaccagtgccggtccacggaaggtccaaatctccttcggcacaccggcggtcttcaccacgcagccgtcaggggcgaggttgccacgcagcacggccagaccgccttcggtgacggccggatgatcgatgtcgtgaatcgcgccgttcacacggtcgcggtcgagggagtcgaacagcgtggtatgcgtccacggatcaggggacacgatgtgacccggggccgccagatacatctgcttggcttcctcggtgcaggtatcacgcatgatgtcccagtcgttgagtttgtcctcaagcgtcttgtaatcgatggaatgcacgtcgcggtgcagcttgccggcacggtcgagctcgccgagaatgccagtgatgccaccggcgcgatgcacgtcggagatctcccattcgccggacggcgaagccttgcagatgcagggcacggtgtgggagatgcgctcgatgtcgtcaagcgtgaagtccacgtcggcggactgcgccatggcgaggatatgcagcactgtattggtggagccacccatggccacatccatggtcatggcgttctcgaacgcttccttggtggcgatggaacgcgggagcacagtctcgtcatcatcgtcgtaatactgcttggcgatcttgacgatctgctcggcggcgcgcttgaacaaatccttgcggtaggagtgcgaagccagaatggtgccattgcctggcagggccaggccgatggcctcggtcaagcagttcatcgaattcgcggtgaacatgccggcgcaggaaccacaggtcgggcagacggtcttctcataggcgagcagatcctcttcgttcagattgtcgtcggcggaggcatacatcacgtcgatcagatcggtgttcttcttcacggttccgtcgggaagtaccgtggtgccggcctccatcggaccgccggagacgaagacggtcgggatgttcagacgcagagcggccatcagcatgcccggcacgaccttgtcacagttcgggatgcagatcagggcgtcggcacagtgcgcgttcacctgatattccacggtgtcggcgatgatgtcacggctcggcagggagtacagcatgccggtgtgtcccatggcgatgccgtcgtcaacggccatcgtgttgaactcacgcggaatgccgccagcttccttgatggcctcggagatcagtcgaccaaccttgttcaggtgcacgtggccgggcaggaactcatcgaaggaattggcaatggcgatgatcggcttgccgaaatccttaccgtccacgccagcggcacggtagagggcgcgtgcgcccgcgaatactcgtccattcatcagttttgcagatcgcatttccatgttctctattgtggtggttaagcgggacacggttttgtcaagagtcactatgtggaattcccagaagcgttatattcgcgagcattgccgaagatgcttgcgcttgccgaaaacatgagagaaagggcttgaatcaggtccagtggcggccctatacttaagactttggaaaagaagcttttggcttatctgatgattgggagataatcaatatggcattcggcactcagccaaccccgaccggtcttgcggaaccgccgatcgatgacttgatggagcatgcggactccaagtacgctcttgctattttcgcagccaagcgtgctcgccagatcaattcctatttcacccagctcaacgagggcctgctgcagaacgtcggtccgctggtggagtatcagaatcaggaaaagccgttatccatcgctttccgtgagatcaatgatggtctgcttgaagagaccctcggcgaagacgatctgaccgaaggcaactgatgtaacggttcttgcgataagaaccggattccaagttttcattcgccccgatacctgagcggtgcgctttgaatagtccatagtgaagctattgattgcgtatgcgaaggacggggcgttttttcgtagcaatcagaagggcgaacgtgtggggcgttcgtgaaaggagcagccagatggctgaattgaagttgatttccgctgagtcagtgacggaggggcatccggacaaggtctgcgatcagatttccgacgcgattcttgacgatatgcttgctcaggatccgcagtcccacgtggccgtggagacatgcgccacggttggccagttcttcgtgttcggcgaagtgacgagtgaaggctattccgatattcagagcattgtgcgttctgtggtgcgcaatatcggctataccagttctcgcgttggtcttgatgcggattcatgcggcgtgaccgtttcgttgaccgagcagagctctgagattaaccagggtgtggctcgtttgagtggcgaagcggagtcgaaggcatctcgcgagcagcgttatgaggctcagggcgccggcgatcagggcgtgatgttcggctatgcgtgcgacgagaccgatgtgctgatgccattgccgatttatttggctcatcgcttggcttaccgtcttactgaggttcgtaagaatggcgaagtgcctcatctgcgtcccgatggcaaaacccaggtgaccattgaatatgatgagcatgatgctcccgttcgtcttgacacggtgttggtgtccacgcagcatgatcctcaagtcgatcaggcgtggcttaaggagcagttgacggaacatgtgattcgtcctgtgcttgatgatgtgcttgccgatcgtgtggcgcatgatgaatatcgcgtgcttgtcaatccgaccggttcgtttgtgttgggcggtccggctgccgatgccggtctgaccggtcgcaagatcatcgtcgacacgtatggcggtgcggctcatcatggcggtggcgcgttctccggcaaggatccgagcaaggtggatcgttccgctgcctatgcggcgcgttgggtggccaagaacattgtggcggcaggtctggcccacaaggttgaggtgcaggtggcgtatgccatcggcgtggccgatccggtgtccatcaatgtggaaacgtacggcactgaaaatggtgtgactcgcgagcagatccagcaggctgtgcgtaaggtgttcgaccttcgaccggccgccattatcgacgagcttgatctgaagcgtccgatctattccaagaccgctgcttacggtcatttcggacgcaacgatgctgattttacctgggagaccaccaataaggtcgacgagctgaaagccgccatcgaaggctgagttacccttgaatcatgagtactgaggatgccgagcagctggcgcttgacgggctcgccccgcgcaagcggcgcaagcgtgcgcccgcggttaaaacgccggctgcggagcatcccatagcccaagtggtgctggatattcaggccatccatttggggcagaccttcgactattacgttgaggagaagtattccgaagccgcccagcccggcgtaatggtgcgtgtccgcttcggcgggcaacgggtcaacggcatcatttggaaacggaccgataccagcgaaacccctgaatcgtcattgcggttcatcgaacgggtggtcatcgatcgtgtgcttgtgtcggaatccatgcgtaacgatgccacacttatcgcggacgcattcggcggaacgcgagccaatatcctgcgtttggcggtgcctccgcgcgtggctcgtgtcgaacaggaacaacgtatcggcaatcgaacgggtattgaaaaaaacggacgtatcgaatcgcttgccaagatcgagcgggaatcgtacgagcagctgcagcggcaatacggtaatatcgacctgcttcgtacggcattggaagggcaacgtttccaagcgttcgtgcttgacccattgccgggatcccatcattggaggcagtgcgtggcctggatggtggccgcggccttattgcagggcaaaccggcggtactggtgttgccgaccatgcgtgagattgaggacatggccgaaacgttgcagtcgatcggcttgcgctgtttcgcgccaacccaatcatccaatggtgcgtacggcggcgatttcgccattctgaacgcgcagatggcgcctgctgaacggtatcgtgcgtatctggccatcagtggagggcaggtgcggtgcgtgatcggcacacgggcggcgatgtatgcgccggtggatggcaatgcgttgttcctcattctcgatgacgtgtgctatcaggatgccgatggcatgatgccttacgccaacgcccgcggagtgttgcggttacgtgcaaaagcgcataatggcgtgttcgtcgcgatggccaatgcgcgcagtgtgcaaagccagtgggaaaccgatgcggcgcatgtcggtgccacccaggtcagcggtttcagtacgccgattcacgcattccctgccgtaaccaaggaagcgagtccttggattcgttggctgaaccgtgacgaattggcaagacttgcggattcgaccatcggagcgcgtgtgccgcacactgcggtgcgagtgctgtcgaaggcgttggaaagcggtccggtgctgttgagcattccgcaggatggcatcggtgaagcattgagctgcgcgaaatgccaccgtcaggctcgctgctcgtactgcacgggtccattggaacggttacgggatgggtcggtgcgttgtcgttggtgcggtgtcgccactgtgcaatgggcttgcccggcatgccataacgaacgtatgcgcgtggttcgtgtgggtgccgccggaactgcgcaggagctgagccgactgtttcgtggcgtgcccattgtgctttcaacgccgagccagccacgcggcattgttcccgatatcgggtttgcgccgcagttggtcatcgccactcccggcgcagaaccccgtgtacgtgggaggaacccctcggaatgcgaataccgggccgtggccattctcgacgcatggaccagcttgtacgccttcggcattgacgcgggcgtagacacgttgacgtcgtggatgcgcgcggtttcgctgtgcgcgccgcgaatcaggggaggtcaggccctgttgatcggcgaaaccgatcccacgctcgctcaatcgttgatgctttggaattcaacgttgctggcgcaaaccgaattgcgggaacgtgaacaaaccgcattgccgcctgtgtttgccgccgcatgcgtatggggacgtcgtgacgcggtgaaggtcacgctggaacgtatcggcgcgttgggtgggggtgacctgtccgccatcgaaaccaccgaaggcatgctgccgtccgtattggggccggtacctattccgcagcctcggaccattgattcgcgcgaattggaaggcactgcggatcgtgtcaaggcggtggtgcgtgtgccgcaaagtcgccgaggtgagttggcgttgcgtttgcgttccgccagtgcccgccatgtggccgcgcgtgaaccgggagaactgcgttttcagcttgatccgaaggagcgaatctgacgcacgtcccctcgccgtgaaaaactagacaggttggcagttcggcatgaggccgcacagcagtgaatggaggatcatatgaagggttggcctggagagcctgatatggagtacgacgtgctcatggctgacggcgaagctgcggtgaatgcgggcaagccgatcaccgatgtgattttcgatttcggcaacgtgctcgtctactgggatccggtggccgtgatgacgccccgctatagcgacgagcttgttgaacagttccttgacaacgatatttccggcttctacgacatcaacgatgaactggactgcggcatgtcgaatgatgacggcgtcgccctgatgcgtgaacgttatggagacaaatgggccgacatgctgcagtactatctcgacaatttcgtcgactcgttgaccggcgtggtgccgggcgcccgcgtgctcatcaacgatttgaaagcggccggcgtgcatgtgtggggattgagcaactggcagaaggatctgttcccgatcgcgctcgacaatttcgatattctgcgcagcctcgacgatcgtgtggtttccggatatgtctccctgcgtaagccgaataaggatatttacgagttcgcgttgcaacagttcggcattgacgcttccggcgcggtgttcgtggacgataaggccatgaatatcgtaggtgcgaacaatgcgggcattcgtggcgttcgattcaaggattcacgtgcgttgcgtgcgctgctgattgatgcgggtgtgaagattcccgcggtgcatcaggcatagtgtgttgcgttccgctgccttacatgctgttgatgcggacggaatgattcccacgatgataacgatgtgatgaggatttgataaggaggacttttcgtgctgaaagtgctgtttgccggtactccggatgttgcggtgccgtcgttgaaaatgctggctgaagataccgagcgtttcgaagtggtcgcagtgctcacccgaccggatgctcctaccgggcgtggacgcaaactggtaccgaatcccgtgaagcaggccgctcttgatcttggtttgccggtgattgaatccgatccgagcgaggaaacgttcatttccgaacttgctgcgaccggtgcccaggccgcggcagtggtggcatatggcaaaatcctgaagcaggatgtgctcgacgcgctgccgatgggatggtacaacctgcacttctcgctgcttccgcagtggcgtggcgcggctcccgtgcagcgttccatttgggcgggcgagaaggtgaccggagccacggtgttccgcatcgtgcgagccatggatgccggtccgattctggcgcagtccactgtggaaatcggagcgcatgaaacggcgggtgagctgctgaaccgtcttgccgaggatggttcccgtttgcttgccgcctcgctgcaggccatggccgacgatcagatcgcgcctgtggaacagcctgccggcgcatatgaggtggctcagaagatcacggttgaagacgcgcatattcgtttcgacattcctgtattcgcggtggatcgtcagattcgagcctgcacgcccaatccgggcgcatggtgcgaactgcacgccaatgccgaagcagaaccggccacgttgcatgtgttgcgtgcgcagggcgccgatatgagcaatcccaacacacccgtttcgctagaaccagggcggatcgtggccggaaaaaagaacgtgtgggtgggtacttcctcagatcctttggaattgctggaagtcaaagcccaaggcaaaaaagccatgcgtgccgccgattgggcgcgtggcgcgcatctcgacggagcctactgcaagtagtgtcgaataaacggatcataacgatattgccgtgtgaacatcatcatttcacacggcaatatcgttatcctgcaatatcggattttgctatatcgcgactcggatctatcgggattcgcatcatcgaagaatgcgaatcaacgaagaaaatcaagaatccgggtcaaatcacgttcgttcacacgatgcggagcatccgcctgaaccgcaggcttggcgcagaacgccacgccaagtccggcggcatgaatcatcggcagatcattggctccatcgccaaccgcaacagtctgacccatgctgatgcccatgcgcgaagcccaatcacgcagtgactgcaatttcacatctttcgtaacgatatcgccaagcacatggccggttaaacaaccatcagcggcttccaaacgattcgcaatccaaaaatcaagatgcgcgtcggcggcaagacggtccacgacttcatggaaaccgccggaaaccacgccgaccttccaaccatgcgcatgcaaagcgtcaatcaaatcaagcgccccctgtgtgaaatgcacgcgacgatacacatcatcgaacaccgaagtcggcagatccttaagcagcgcaacacgagcctgcaacgcctcgcgaaaatcaagttcgccattcatcgcacgtgcggtaatcgacgcgatctgctcgccaattccagcggcggcgcccagctgatcgatgacttcctcatcgatcagcgtggaatccacatccatcaccagcagtccaggctgggaaagggtgggagtgggcgcaatgtttggcgattcttgttcaagcatggttttgattgtcggaaatcatgaggacaatgggtattcttaagggttgagcatgttgaatgcgaatgcgccatgacatgacgaaatgacggaacggctcgaaacgcattcggtggaaagcgaggctgatgaaatggatcaacgtgatgagacgttggcgtcgttgggtgaggccaacgaccagttgatggccaagaatcatgcgttggccaaggcgttgagccgtgccacccaggagctcaccaaggccaaggcccagctgaaccagttggcgggaccgcccatgaccttcgccaccatggttcgcgtgcattcctctcgcacggacgaacagggggtacagcatgccagcgccgaggtgatttccggaagccgtcgcatgatcgtgccggttgcggcgaatgtgcaggcatccaggcttgagactgggcgcacggtgctgctcaacgagaacatggtggtggtttcgcaagccggcaccgatgctgtgggcgcagtgcgcacggtgaagcaggtcattgatgatgggcgattgctggtcgcggatggcggtggaaacgttgcgttggtccgccgttcgggagcgctgtcgaaaacttcgatcaatgtgtccgaccgtgttacggtcgattcgtccatgagattcgcgcttgcgttggttcccgcgcaggatgatgccgacttggtgcttgaggaagtgccggatgtcacgttcgctgatatcggcggtttggatgagcagatcgaacgtattcgcgatgccgtgcaaatgccgttcctgcatcgcgaactgttcgaacgttatgatttgaagccgccgaaaggcgtgctgctgtatgggcctccaggcaatggaaagacgctgatcgccaaggctgtggccaatgcgctcgccgaaggcgctgccggcggtcgtggcgtgttcctgtcggtgaaggggccggaactgctcaataagttcgtgggcgagtcggaacgcctgatccgcatgattttcaagcgcgcgcgtgagcgtgcggcggatggcaaaccggtgatcgtgttcattgacgagatggactcgctgctgcgcactcgtggatccggcgtgtcgtcggatgtggaaaccactattgtgccgcagtttttggctgaacttgatggcgtggaaacgcttggcaatgttatggtcatcggcgcttcgaaccgtattgacatgattgatccggcggtgttgcgtcctggtcgtttggatgtgaagattcgtgtggagcgtccgaaagcggctcaggcggcgcagatcatccgccattatctgaccgacgatttgccgttggtgccaggggtggatgcgaaggctttgattggggtgctggtcagcgatatctattcgacggacgagcaccggtatctgtgcgacgtgtgcgatgagcatgggcaatggcatccgatctatctggcggatgtggtgtcgggtgcggtgctgaaaaacattgtggatcgtgccaaaacccgtgctgtgaaaatctccatcgaaagcggacagccggcggcgattggcgtcgatctgttggcgaaggccgtcgacgaggagtttcttgaaacccgcgatgcggtgttggacgccaatccggaacagtggagccgtatcaatggtttggaagcagggcgcatcacccgtatacgaccagtcgaataatgctggcaggcaacgcgaaatcagacgaagggaagtcgtatcaatgagcgttcgtcgaatcatgggcacggaaacggaatacgcggtttccgctctcggaatggagcattacaatccggtgaagctatcgttcgatgtggtcggtgccgcggcgaacgaacaaaccaagcatattcgctgggactatcggcaggaggatccggtcaacgacgcccgcggcaccaggctggaacgtgcatccgcgcatcctgatctgttgacggacgcgccgcagctcaacatcaccaatgtgattgcagtcaatggcggccgtgtgtatgtggatcatgcgcatcctgaatattccgcgcccgaaaccgatgatcccttcgatgccgtgctctacgaccatgccggcgatctcatcatgcgtgagtgcgcgcgcaaagccagcgaacagaccggtatcgcaatcgcgctgcaccgtaataatgtcgacggcaaaggtgcaagctggggcacccacgaaaattatatgatgctgcgttcggtgccgtttgaccaagttgcgaaactcatgacggcacattttgtagcgagacagatttttaccggatcaggtcgcgtcggtatcggcgaacgaagtgaaaccgccggataccagctcagccagcgcgccgactattttcatatgaaagtcggtttgcagaccacattcgacaggccgatcatcaatactcgagacgaatcgcacagcacggatgcataccgtcgattgcatgtgattgtcggggacgccaatcgtatggatgtgccgcaggcgctgaaactcggcaccaccagcatgctgctgtggctgcttgagcatgccgaagaggcgggattgaacatagacgaagcgttggagccaatcatgctcgccgatccggtgagcgccatgcacgaggtgtctcatgatttgacattaggtgccatgttgccgctggaatatggcggcgagacctcggcatggcagattgaggtcaccctgcgtggcctggtgtatgctgccgctgccgtgatctatggaaccgacacgtccggtgaaccggcatggtctgaccgttcgacccgtaacatcatggcgatgtgggggcaggcgctcgccgatgtggctgccatcaggcatgccgatgatgatgcgcgtttgacgatgcgcgagcaagctggccgcattgaatggctattgaaatggcagttgttggagaagctgcgtcgtaaaattggctccggttgggatgatgcgcgtattgcggccgtcgatttaaagtgggctgcgattgatcccgctgactcgattttcgatcggttgcgtgcccaaacggagcggctgtttacggacgggcagttggtgcaggcttcggtggaagcgccttccgatacccgtgcttggttgcgtgccgaaatgattcgtcgttttccagaacaggttgtggccgcatcgtggtcgcatcttacggtgcgccatcgaacgattggtgataataccgtggagaatccgatggtctcattggatatgtcagaccctctgaaatatagcaaatctcaatgttcccgctattgtgagcgtgtccaagatgcggcgtcgattttggaaatgttacggtgaaatgcaatctgtgcgggtaacattgccatcaattggtcgcgaagaacgaccattgacaacaggtaacatcatcccggtattttgaggagaggacgtgccgggactgtacagaggaaacgaaaaggcatatctatggaactgaggcaaatcgccctcgaagtcgcacgcatcctgcaggacgcaggcaagcatgcgttgaacgaccagatgaatccgcacgacatgagaaaactggaagtgtccgaagactgcttccacttcacttcagacaccgacaagcgcctgcagcagttcatcagcaaccgcctgacctatgtcaacgtgttcgacggcttctggcagcttcgccctgaacagtgctatcccggccagcgatactggtgtgtgggtggcatcgacggcgtgatcaatttcgcgcgaagcatgccggaatgggccatcaccgtgacattgttcgaattcaacgaccagtgctccgcacagccgatcctttcgattgtgcacgctccggcgctgggattgacgtatcttgcggtgcgtggatccggcgcgattcgtattcgcaagactccgttgggagacaaacgcgagaaaatcattccttccaccacgtcgtccctcgatggttcggtggtgagtttcggcatgtctccggtatcgtccgaatcgcagcgtgcgctcgatgtggtggcgaagattgccggacgtcctgccgatattaaacgtgtcggcccggcgtcccttgatttgtgcaaggtggccgacggtacgtacgatgcgtatttcgaaccgcacttgcatgagtgggacgtacctgccgtgtctgctggtgctgtggtgatttgggaggcgcaaggccatctgacccagtggaacggcgaaagcgttcactggcgccaggagaacgatgtgatggccaccaatggtctgatcaccaatgatctgagccagtatttggcatagtgttgcatgctgcgccacacctgatataaggtgtggcgcagcgtttttttgcaggtttgcaaccggaagttacagggaggaatgtcatgcctcaggaatttgaacaggctcaatccgcatccgcaggccaagaggtgggtgacattgtcgaatccgccggcgtacaagtcgacggaaccgctgatgcgttggatgccgtgcttgacgatatcgaatcggtgctcgagtccaatgctgaggaatatgtcggtagtttcgtgcaaaaaggcggcgagtgatgccgcagctgcgagacagcggcaatcattcctcgtcaccgcttgatgcgggaacgttgcgtgaggttcattctttcgctcgtattttcggcattgaaacggaatacggcgtcagtgtgaccggtgcggatgtgccatgcgacgccagccagacggcaatgatgatgttccagccgatcgttgcctccgcgcgatcgaccaatacgtatattgaaaacgggtcgcgactgtatcttgatgtcggatcgcatcctgaatatgccacgtccgaggcctgcgatcccatggacgcccttgccgtggatgcggccggcgaactggtgatgcgcgatcttgcgttggacgcccagcaaaggcttcgagccacgcatgggccacgtgccacagtgcatgtgttcaaaaacaatgtggattccgcagggcattccttcggctgccatgaaaactatctggtacgtcgttttgtgccgttggacgtcatcgaacacgaattgctgccgttcctgattaccaggcagctgttcactggcgcaggcagggtgacggaatcaggtttccagatcacgcagcgtgccgattttctggatgaggctgtctcatcggcgaccacaagatcgcgtccaatggtcaacacgagggatgagccgcatgccgatcccgacgccttccgaaggctgcatgtgatcatcggcgattcaaaccgttctcaatgggccacgatgatgaagctggccaccacgcatctggtgctgtgcgttatcgaacaggctgggcgtgaaggacgtgagtcgggattctcgcggttcgcgttcgcggacgccggtgccgcaaaccgtgcggtcagtcgcgatatgagcggcgtgaatgcttcgtttgccatggccgatggatcgacgttgcagggtggtgccgtagccatgcaggaacgttatctacaggctgtggaacagttcgtggatgagcatccggaagtggcttcgtcgttgcctcgcaccgatgtgcacgatgtgcttcgccagtggcgcaatacgttggaagcgttccgttccggcaatgcaaatgctttgggagacagcgtggactgggtgtgcaagtaccgcctgtttgaagcgttacgtgcccgttccagtgcggatcttccgctgagcaagctggaacagttggatctggactatcatgacgtggccaatggcgcgttgtatgcgtcgttgcttcgccgtggtgccttgcgttcgctgattgacggtcgtgaggcgcaaaaggcgcgtaccatgccgccggcggatactcgtgccgcattgcgcggcagattcgtcagtgcggccaaatcgcatggcgcgcagtattcctgcgattggaccagactatcgttgcatgcgccgcggaagatggatatggtgctgctggatccgttccaatgcagggagaatgaggatttccaagccatgattggcgctttggagtaagcgatggtggcaatgggaaacgtcgatgggagtggggtgtggccgacaagcttcggtcacaccccactcccatatcggtatgttctcctgaattgttttgcgattgcgctgcggtcgctttcgtttttgattggcttgaatcaggcttcgccgcgatatttcgccatcatctgcgattgcagctgttgcgcgcttggcggcgtccatgtgatggcatccgcgcccgcttcgatggtggcgaggatgcgatcttcggatccgcctcccgatgccaggatcggtatttccggatgatgcgcacgtatgcttgccacgacttgcgcggtgcgtgctccggctgcgacgttgatgatggccgcaccggcgagaatcttgcattcggtgatttcgtcgtcttccgtgactgttgcgataacgggaatgtcgaccatggacatggtggtttcgatggtttccgcgggtgccggcgcgttgatgacgacgcctgccgcaccttgcatttcagccaccatggccagctcggtcacacgcggaccggtggtggtgcctcctccgacgcctacgaaaagtggcatttgtgccacagtgagcaacgcctgtgtgatcaccggttctccagtgaacgggtagacggcgagaatggcgttggcattggtattacggatgatcgcagcgtcggtggtataggcgaacgatttgagcgtatggcctttgactgtgatgccgccgcaatgttgcgatatgactgcgggtactctcgcattgggggaggagaggcgaccttcgatgcgtgcggttccataacgggttcgtgacacatgtggtgttgtggaatgctgttccacggccacggcttcactgggagtgaacagggatcgtttgtcgatgcggattggtttgggggcatttgcttcgggaatggtctcctgctcgtcgctcattcctgcacctccgtatctgtgtgattcagcataaggaattcatggatggctttgcgtcgctcgacaacctcttcatcgagaatcctggtgtcggtgttgtcgatgatgcgctgcagaagttcgctgagggtggaaagatcctcggtgctgaggcagtcaagcatgtgcgttgccgtgtcatggcttttgggaagttgttgcagcggtggcacgccacgacgtgccgcttcgacgttgcatactcgtgtggcggctcgtagcgcggtctgtgtgcgtgtggccttcagcttggtatgcagcagcagaatgttcaattcatgcagttgattgatgacttccttgcgttgatcggtcatgtctctctccatctatatggacacgatgtctaatatatatgcatagtgtagcgcagaatgacgcttgtacaagtgtcatgaacgacgaaagccccgaccgtcatggtcggggctttcgtcgtgtaagcaacatatcagtacatgacttacttggtgacagccttcttcagcagggagccggcggagatgcgaacgccgtaggttgccggaatctcgatggtctcgccggtgcgcgggttgcgtccggtgcgggcggcgcgcttgacgcgctcagcggagaacaggccggtcagcttcaggccttcgccggactgcatcgcctcgacgaacacgtcctggaaagcgttcacagctgcctcagcctgtgccttggtcaggttggacttctgagcgatcttcgagacgagatcagacttgttgtatgccataaagcatccttcttgggtcaggggacattctgattacgaacatccacgttctctatgatattagcgcactcttatgaggaaaatggcattttacaagggttttggtcgcttttttgaaaatcagggggaaaacaaagtgtacgggggtgtttgtcagatcaaattatgcatgtcaagccatttcatggccaacgcaccgaccggaatacgcaaccagtagaaggcgattcggtagacaagagtagcggaaaccgcgatggaggaggggatgcccacggcagtgaacgccaccgacagcacggcctccacggcacccagaccgccaggagtgggaaccgcggagcccaaagtgttggcaagcaggaaaatgaaggtggtttccgcaggattcgtgtggtatccaaacgccatcaatgctgcccagaatcccagtccggtcgcaaggttaagcaccagtgcgccggcaatgccaagggccagttcctttggccgtgcaagcacattgaccaggttgcgcgcgtatgctttgaccactggaaggtatttctcggtcaccaaatgacgcactggaggaatcgccatggcggccgacacaaccaacgcgacgatggcgatcaccatgatcagcgtattggtcggaatcatgccggacaatgtgttgcggccggtgaataggccaatcgtcagcaacaacacgatggtagtgcctccctgtacggcccagaccgcgctcataaccgcggtcgcagccgtactgcgatagccgcttttacgaaggaactgcaggttgacgaatgctggaccgacgccggccggcatggacaccgcagtgaaaccggacgccatctgagagcaatacaagccgatcgtgttgcgtttatcggaatccatgaacacacccaaggtgatagcggaaccaagccacgccacaaagccaagcgcgacgcaaaccaacgccatggcgagattggcgtctctgacggccttgatcatttcggccggctgaatctgggtgaacaccacatatacggcgaccaccagcagcgcaatcgcaatgaacgagcgaagactgaaccgggaaagcgtgactttttccatggaatccgcgacatcctgcggagcgagcgccgaaatacgcgtacgtaaatcggtaagcacatgcttgtcccagccaggcaatgcgcgcgtggaagcgggaatggcagccttctgtatgaagggtgccaaatcgatcagctgctcgtctccccaagtcctgcgagcgcaggcgatcgcacgatcattgccattgagtgtggcaagaagaaccagcaactgtactttgtcgagtgcgaagttcggagcggaactgccataatcgccattatgccaacctgcgattaccggatgcccgttttccatgcgggacagggtttccggagtgatgcgacgatgggtgaagccatgatggtgtgctgtggtgagatattccatgaacgcttccatatcatggtcggacatggtgttttggttgcattccaatggcatgcggttgcggtggaacaccagaatggaggattctccataatcggccacaccatacacgcgcggagtttccaaaccggcattggacaggccgagaatcatggcgtaatgatggtgcatggcgtcaaccgaggaacggtcgcgacgcatggaaacaccggtcaggcgaagccactgccatacttggttgagatatccggccgcatgcacttgattgtcgagtacggaaacggtgtattgcttgccgtcatagtcgacaacatcgtaaatacgggaattttcggtcagatcgtcatccagcgtggccttcaatactcccgaatcgacgtagggggcgactcggcgggtgagcaatgatgtgtcaataccgatggaacgcaatgattgcgcgatttgtgatccccacgcgccattgttctgcgtgcctatggcgaaacggatcagcatgccgataacacggcctatggcgtaggatgcgatgacgccagccagtgaattccatgaaagcacgaccatcagcactgccactgcatacagcacgttccagccccatttggtgcatgagcggatacgccgagggccggagacggtgaggaacgatgccatggcggcataaaaatcggggagcagtccagtgcctacggatgtgctgttggattgcagtggaatgatcagcatggtattgccggagttgctgatcagcgcggatatgccccacaccgcaaagaatccgaatatgagggaaaccacggaaatcacgctttgcagccactctttggaagtaagcagctggatgagcacgctgacggtgatgcatacgatggcaagctgctgcaataatgccgagggaacatccatcagccagctgaccacgcggccggcggaatgaacgtcggattccacgccggacgcggtgccatgcaagtacacggagaacagaatcacgcctatgccgagcaccaaggcgaagaatgcgtgcgtcagatcggcgaaatcacgactgcgcttcggcggcacatcgtcgatatgcggggcgggcttattgactgcaggggagtgagacactgttgacttgctccatacgtgagattggcttcaggtgggtcatatcgccccactgcattcgataatacgccctgagggtggctacgaaatacgcggccaccctcagggcgtatggttttggtacttatttgacagcttcggttcagcggtcgaaatctaccagtttgctggcgacgccggtatatgttgccggagtcagcgccttcagacgagccgtggtagcgtcatcgaacgcctgctgatcgatgaactgctcgacggcttccttggagatctcatggccgcgcataagctccttgaccttctcgtacggcttgtccatgcccggcaggccggcaagttcgcaggcgcgcatggcggtctggatcggctcgccaagcacctcccagttggagtccagctcggcttcgatggcgatgtcgttcggatggatggagttcagaccgcccatcagattgttgaacgcgagcacggagtagcccaacgcggagccgatgttgcgttgcgtggtggaatcggtcagatcgcgctgccaacgggattcgaccagcgttgcggacagcgtgtcgagcagcgagcaggagatctccagattggcttccgcgttttcgaaacgaatcggattgaccttgtgcggcatggtggaggatccggtagcacccttgactggaacctgggcgaacacgccacgggagatgtacatccacacatccacgcacaggttgtgcagaatgcggttggtgtggctgatggtgccatacagttcggcctgccaatcatgcgattcgatctgagtggtgagcggattccacgtcagacccatgcggttggtgacgaattcgcgggagacggccacccaatcgacatccgggcatgcggccaaatgcgcgccgaacgtgccggtagcgccattgatcttgccgagatattcctgagccctgaccttgttcagctggcggttcagacggtacacgtacactgcgagttccttgccaagcgtggtcggtgtagcaggctggccgtgcgttaacgacagcatggccttgtcacggtattcctcagccttctgagccaaatggtcgacgatggcctgagcgcccggcagccacacattctcgatgccgtttttcacgcagcgggcgatggacaggttgttgatgtcttcggacgtgcatgcgaaatgtaccaaagtcttcaggccggtcagctgggtgtcgtggccaagcacgtcggcggccttgtcgagctggtcgtcgatgtagtattccacggccttcacatcatgatgggtctttgcctcatgggcggcgtgttgcgcgataccctcggcgccgaactcctcaggaatggcgcgcaggaacgcctgttcctcatcggtgagcggcttgacgccgggaacgatggtctggttgccgttgccctcgaaaccgttggccagcagaatcatccattcgacttcgacgcgcatgcgctcgcggttcaacgcaggttcgctcaaatattcgacaagcggagcggtctgctgatggtagcggccgtcaagaggggtcaatgcgattgcaggggagatatcagtaagcttcatagactacagcatacgttcagccgtaaacgaaagttgcgtatctgtccgctcggtggatggctttcatgatgtatgccgtgataccgttcttgttgcgccgtggctgcagtgttttttcatttgctcatgcgcccttcgaaatacatgacttcctgcagatcgccgtcgatgatctcatcgaaatgccgttcgtgggtgttcactgcggtggatcccatgtccgttgcgttctggtatgcggcttggtgatatttgagccaatgcgtgatttccttgttgtctggagcgtctgtgacgggagtgcctgcgaacgttgattcctggttgctgctggatttgcttgcggtgccgcgtacggtcagccaatggtcggaactggggttggcggcgccatcgagggccgccacgagctcgtcgtccatttccacgctggtcacccatgttttttccggaatcggatgattggcgacgggcgacccggcggtaaccacatgttcgatgtcataatcgtctttcaggtccgaggcgatggtggcggcaacgatgccaccttgcgaatgtccgatcaatgcgacgggctcattggatttgatgccggcctgtttcatggcttcctgcaccattcgcgcactgtccgcttccatgcgttgcttgctgtccgaactcatgagttcgacgttttgcggccacccaaatggagaatcgtgcttgccgtctgtgcctggaatggtgacgagccatgagttggttccgtcggatttacggtatttggagatggcgatggtgccgtagtcaagtccgctgtcgagatcggtcttgccgagacgttcctcggcaagacgtcgaagatcctccatggcctctccgacattatgcgattcacgcaccacttcggttttcggatggacttgggtgacggtgagattgttgccctggatcaggttgtaaccgcgcgacgatgccctggagatggtgccggctgcatggttgacctcatcggtacgcagcaggcctttgaccttgccgtatccgctgaccgcggcgccggccgcgctcatgatgccttcctgcgcccaatccaacgagtccagcagatatatgggattggatttgccctcattggtggatcccatcacatatcccaaggcggacatggctgcgccggcgagtatcgattccttcgggaacgatgtgatcgccacttgcagcagttcgttcagtgttcttctgccagcgtcgtcgacctgggaatataacgattgcgcgcgaatgatcagcgccgatagctcagacaatcttgccgccatggctcccagcgcgcttgcatgggcgtcacattgttcgacgagctggtcgtatggcagttcgatgtgatccgtggcattgcaataggggcttgatccggacagcgaggcgatggccgacgacgcataggggtaggaggaaagctgaaggctcaatgcccggactgaatcatgggcgcggttcagagcgtcggcttgatggctgagggcttttgccgcgcgcatatatgcctcggtttcctccgtggagtatttgcatccgccgctgactttggcggtcacttcccagctcatgccgtacctactgcccataggagacgcaaggtggcgttgatcgaatcccgtagcgtcagggattgcttgcgtaactcatcaagccgcgcgcggtatgattcggcggcggttcctgtccaatcgggcaatgaactggatgcgagcgtggcgtcaagatcgtcaagatgtttcgatatggacgtgagcttggcattgacgagcagttgggtggttcgcacgccagcacggcaatggcatggcatgcctggcgttgaggccaaggtgttgatgaggttgaaccccagtccgggaataaacggataggtgattgatgcgttcatagctatattggagcacatcgggcggttgcccaagccggcgaacaaggcttgtggtcggaggacgggcgaaaagcacgatgtcggcgtgtcatcgttgaaaaatcaacaaaaacacgccgacatgcctgtggataactttctgaaataggcccccttaccagggttttgcgggcgaagatgtttggttggaatcctgcttggccgccgaaccggaatcatcggaatcggattgggtggactgtgcgttctgggccagaagctcctccaccttctgacgctgctcgtcagtcaaggttcctccgttgccttggcctccatcggtgacggattgcccaccttcgatggctgtgtcggcctcggtgccgtcggcatgctgcatctctccgattttcttgcgtatggattcggtcagttttgccgaaacttcggcattatgctcgatggatgtgcgtacgtttggcagcagcaacatgccggccgcgccagcttcacggaattgcgcgtcggtctgctgctgttgggtctgcaatttgtcgaaatcggcgttttgctgttggctggctttgatattcgcattcagactgtccgtggcctggttgtagttgctgacggatgcgagattcactatgccaagcacgcccacaataaccgatatggctgcgatgacggcgatggcgatgcgaacgggcagcgatgcacgcgctgtaacggttgtgctcacagcagcctccttgattgcgtgatccatgccccggcctcgaacgtcagcagcagcgctacggcaatggcgaacggccagaccatggcgacggttcttgtgcgttgcttggatgtctgcgtgacacgccatttgctggatgtctctttggaatccccgccactcatggtcgtcgtggcattgagctggatggcggttccactgagctcgtcggcgatggcgttcatttcgtcggcattcatgcgggacacgccaggctcgccggtttccggatcggtgacccattgcgtgtcgccttcctccacgccatcgccggtcacggggatattgcctccctgctcgctgcccacggcgacggtgaacgcatcggaaaggtagcgtcgcaacgatgagaacgttcggcgtgttttcgacgaggtctgctcgccatccgaaatcaggtacagcacgatcgcatcatcgggatgctgatcgtgaatcgacttgcatgtgagcaacaactggtcaatcggcacatccaaggtcgaaccggccgaaatggaagtcgattccggtgcaagcgtgtccgcccaattatcgatcgccttcgaatcaggcgtcaacggaacatccaacgttcccgaagcgccgaatcgcaatgccgcgaaactggaattcggatacatggcggcaatatccttcaccgcctgcttggcaacatccaagcggctgagctgttcgtcggaaccatactgcgcgtccgcgaccgccatggaaccggtcacatccaccgccaccaccacatcggtggtgttaatcgcacggctgttcgtggacgagacgatgcttggcgtcaatgccatgatggccaccagcgcacaaatcatcgatcgtcttgcgcaagcccagacggtttcatcgctttggctgcgtctacggatatgaagcacaatctgcgcgactgcgcaaaccagcatgatcacgcagatcgccgtgcctaaaggccatcccaaagcaggggagagcgtcagattggtcatcgcctcaacctccaagccaagagcagccaaatcactatcgccactgccaatgccagcgtccaccatcccggtgcgtccgatattgcggccttgctgcttgccgcgctgtcatggttgcgccgcgattcgatttgcttgaccagctcagccacggaagcgccgttcgattgcgtgagaaacacgccgccatgcgattcgatttcggattcgaactgtttggtcgtctgttccgattcgctttgctgcggtccggagaacagtccgtccacggtgatttccgcctgtttggtcaggtcaagagcctcctgaagcgtgtatgtcggatctccggaaacgacattgtcggtggcgagcacaatggaagcggcacgttgacgggatgcggtctcggcgttggaactgccgtaggcgaaacctggcagcatggctgcgcaactcaccacgccgtcgccgatcagggaagtggcctctttacgattctgcgtaccttccagccagtcggaaatcgcttggtaatcgctgtctttcatcttgtcgatatcatcctgcgattcgacgcctttcagtatcgtgctggtcttgtcgagctgttcggacaccaattcgtaatcgtcggtcaacggaaacacggtacgtgacgtggaattgaaaatgctcaatccgatgcgctcgcccttgaaattgtccaccaatgtgcggtaggtatcgatcacttcgcggtcgtatggcaacgccgaaccagatacgtccaagcacagcacgatgtcgcggctgctcgcacgctcctctccctcatccacggtgctggggcgtgccaccagcgctatcgccagcaccagtgccatcaccaacagaacgacggcggcacgtgacatggtgcgccactgccgaaataatctcgatgcggtttcggtgttgagatcgtcatccaaactgaacgtccgcacggatcctgagtcgttatgcctgcgttttgcggacgccaataccatgatggcgatgacggccaatgacgcaatcaggcctgcaaggcctacccacggccagtgccatgacaattccattcatcgccacctttccacaagattggcaacccactctccagcctgttcaaccgtggcctctctggccgtgtgattgcgttcggcatccgcgaattccggcggatacaatgcctcgatggtctgcctgagcagggtgagcccatgctggttgccggtcgtgcgaggtgtcgcttcaatatcggtgagcgtctgattgcgcacgtcgctgccggtggccgtggagacgaaatctctggcgatcgatgcgagcagggcgaacgcttcctctcttccgagatcgccgttggcatgacggtccaccacatcgttgatgcgttcatgccatatcgacgtgcccgtcgatgcgtcgtgacgtccgcgattggttttcttcgttggcttgagagttggtttcgacagccataccaccaagacgacaagtgccacggcaaggatgaggcataccgcgacaacgatgcccagccccgtttcgatatgaatcgggtccagtgtgtcgaaatcgttgcgagacaaggcgatgtgattcatgctttgcctcccaaggtgagtgaggacggtgctttgagctgattgcgtgtggagcgagatagggatgcggataccatccgtacgaattcccggaacatacgttcgcttgaatcggcacggatcactgtggaaccgcaacgattcagctcatgtctgatggacgcggacagatattcgcgatgcgtgcgaacctcctgcgccgttttgccggtgcgcaggaatgccggaatgcggcggtcgctgcccgcgtcgaatacgtcgcgcgcatggctattgtcgaacggattaatggttgcgacatcgataagcaccatcggatgggtccttgcgatcctgcgaatggactccacgtgacgttccttaagtgcgtgctcatcggtggcgatcaccaccaacgcatccctgtcgcgaatgcgacgggcgtactccagcaaagcgtcgatattgcgaggtttgttccaatcacgctgcagcgcattgtccaacgtctgttcgaattgcgtaagtccgccattgaatggcacacgggtgatcgagcctgaatcgccgaatactatggacacttcgtcaccacgacgcaggctgagcgccgcgaacatgcatagggcgttggctgcgacctgatgaacctgttcgccggaaacgcaggtaccggtcatttcctgtccgacatcgagcaaaagccaggcgcgtgaagtggatgggcgttcgcgctgcaccaccatggggcggcccacacgggcgctggtcttccaatcaatccgttttgcctcgtctccaggctcatagatgcggatatccatgacatcgtcggcgccgaaacgcttgtctgatgcgtgcgcaccctcaagaacaccgagcgccttgcgaacagtcggcaggctcaacgtggttccgagggcttcgatcttactgcggatcggatcttcggaacgaattgcgtcgatcatggaacgggaaccgcctgaacgatcgagtccacgacctgatcgctggtgacgccgtcggcaagggcctcgaacgtgagcaggatgcggtggcgaagcacttcatgtgtgaaggctttgacgtcttccggaatcacatagtcgcggccttgcatcaacgcgttggcctgtccgatgcgagtcagcgcgatggacgcgcgtggcgaggctccgagacgcactagtgtggacaatccctgcaccggcttggtgccggctcctcgggatgtggcagtgatatcgaccgcgtatttcatgattgcgtcggacacatgcacgcgacgggccgcggcgcgcaggaattcgacatcgctgatggacacgacgtcaccggtgagcgttcgtgaatcaaaagtgtcggagccgcggtgggtgagcatggtgagcatgcgctgttcctcctgcgcggtcggatacgtcatgacggctttcatcatgaaacggtccatttgcgcctcaggaaggttgaacgtgccttcctcctcgattggattctgtgtagcgatgaccatgaacggtttcggcagtgcgatgcactggccgccgatggtggtggctccttcggccatggcttcaagcatggccgattgggtttttgcgtttgaacggttgatttcgtcgagcagcacgaagttggcgtggatcgggccgatctgcgtggagaacttctgcgtcgcgaaatcgaagacctgggtgcccaccagatcggatggcatcagatcaggcgtgcattgcactcgcttgaacgatccggacacggaagtcgccagcgtctgcgcggccgtggtcttggccagacccggtacggattcgatgagaatatgtccgcctgccaccagcgtggtgatcagcgattcacgcaggttgtcctgtccaactagggtctgcgcgaagcgtgcgcggatgcacgtgccgagctgtttcgcccggttgatgtcctctgggggcaacgtgctcggtttggtgacggccggcattggaacgggggttggtgtcggtaccggattcttcggagggaataaagccatagttgctactgtaacgggtcaagctgacgggagggaccagtccacaggcttctcgcctgcggcgatgagcgcttggttggcgcgggagaacggttttgaaccgaagaatccgtatcgcgcggacataggactcggatgaggtgaggcgataatatatgcgttggtgagcagcggtcccagcgtctgcgccttgcgcccccacaggatggcgaccaagggtttgatgctgccatcgggattgcggcggttgttaagcgctttgatcgccgcgtcggtaacgatctcccaccccttgtcctgatggctgccgggcttgcccgcttcgacggtcaggcatctgttgagcagcataacgccttgattcgtccaaggcgtcagatcgccgttcgtgggcatgggtacgccgaggtcatccgtcagctccttgtatatattggtcagactacgaggaatgggctggacatcgggcgccacgcagaagctcagtcccaccggatgaccgggggttgggtaggggtcttggcccacgataagcaccttgatgctgtcgaatgggatggtgaaggcgcgcagaatgttcgcgctggcgggaagataccggcgtccggctgcgatttcgcctcgaaggaaatcgcccatgcggtgcacctgtggctcgacctcggcgagggcattcgcccatccgggctccacgagatctttcaacggcttgatgttcgattgtgtcatgcatcttactgtacgacgtgttgcggtcctgatgacaggggtggtttggttttcacgggatggtttcacgaacgttcggaataggggtgggaatgcggctcgattgtgttctgactgaggtggtcggtacacttggcagataagtgtgtgagaaacgaggtttgcaatatggctaagcaggacaaggagacctacgattcctacgagaaggatgtgtacgacaatcctccggcgggacctatgggtgttcaccgtggcgcgcgttccgcggcgtcccgggccatgccgtacgtcattgtcatcattgtggcgctgcttgctggtttgctgttctggagcatttattcaggtgagatcaacaatctgaagatgccgtggtcgtcgcaggagagttcgactacttcaagtgccgaaaagagcaagagcggcgagagcaagtccaagtcccaatccgactccgcttccggcaataagacggacgcatccaatgccgattcgccgaccgactcgcagcaaaatgatcagaacgccgaccagaatgccggccagaatgccgagcagacggataacgccactgcgcagcaggctgtgaacacgggtactgaggttcgcgtcgtgaacgcgacgaatatcaccggttatgcgcaaagcaaggccgacgtgctgacccaagccgggtataccagtgtttctgccagcaatccgacgggaaacgttccttcgcagaccgtggtctggtatcagaacgagaccgataaggcgaccgccgaaaacgtcgcacagacgctgggaatttcgaatgtgcagcaaagcgatggactcgtcacgccaatcgttgtggtgttgcttgactgaaaaacgccgtgagcgaaacaaaaaagccttgttcttttcccaaagaacaaggtttttttgttttccttggaattccaacgttgatggcttatttagacgaacaattcttcttgcttacagcgcaactggcgacatggagtttggcactctcggcctgagagtgctaatctgccaattagcactcgaggagcgagagtgataactggcagctgacggctggtgcgttcttcgcttcgaaggtgggaataataccgtgtagccatatgtggaggaacaatggcaaagatcattgcatacgacgacgaagctcgtcagggaatgctcgcgggcctcgacaagctcgctgataccgtcaaggtcaccctcggtccgaagggccgcaacgtggtcctcgacaagacctacggcgctccgaccatcaccaacgatggtgtctccatcgccaaggaaatcgacctggacgacccgtacgagcgcatcggcgccgaactggtcaaggaagtcgccaagaagaccgatgacgtcgctggcgacggcaccaccaccgcaaccgtgctcgcccagtccctggtgcacgaaggcctgaagaacgtcaccgccggctccaacccgatcgctttgcgtcgtggtatcgagaaggcttccgaagccatcgtcaaggagcttatcgcagctgccaaggacgttgagaccaaggatcagatcgctgctaccgcaacgatttccgccgccgatccggaagtcggcgagaagatcgccgaagctcttgacaaggttggccaggacggcgtcgtgaccgttgaggacaacaaccgcttcggcctggatctggacttcaccgaaggcatgcgtttcgacaagggctatatcgctccgtacttcgtgaccaacgccgaagatcagaccgcagtgctcgaagagccgtacatcctgctgacctccggcaaggtgagctctcagcaggacgtcgtgcacatcgccgagctggtcatgaagaccggcaagccgctgctgatcatcgctgaagacgttgatggcgaggctctgccgaccttgattctgaacaacatccgcggcaccttcaagtcctgcgccgtcaaggctccgggcttcggcgatcgccgtaaggccatgctgcaggatatggccatcctgaccggcgcccaggttgtgtccgacgaactcggcctcaagctcgactccgtcgacatgtccgtgctcggcaccgccaagaaggtcatcgtctccaaggacgagaccaccatcgtggccggcggcggctccaaggaagacgtggctgcccgcgtggctcagatccgtgccgaaatcgccaacaccgattcagactacgatcgtgagaagctgcaggagcgtctggccaagctggctggcggcgttgccgtcatcaaggttggcgctgccaccgaagtcgaggccaaggaacgcaagcaccgcatcgaagatgccgtgcgcaacgccaaggccgccatcgaagaaggcctgctgccgggcggcggtgtcgctctggtccaggctgcagccaaggccgagagcgatgtcaagctcgaaggcgacgaggcaaccggtgccgcgatcgtgttccgcgccatcgaagccccgatcaagcagatcgccgaaaacgctggactgtccggcgacgtggtgatcgacaaggttcgttccctgcctgacggccagggcctgaacgcagccaccaacgagtatgaggacctgctggccgccggcgtcaccgacccggtcaaggtcacccgttccgcactgcagaacgcagcttccatcgctggtctgttcctgaccaccgaggctgttgtggccaacaagccggaaccgccggcagccgctccggccgctggcgctgacatgggctactgatccaacggtttggcaaagcctgacggcataagcaaaaagctataagtggagtccgtttcccatagtggacgcgggctccactttttgtttgcgccagctattgctttgattgtgtcggaagtacctgccgctactgcgcaaacagacgcgatgcctgcatttcggtttccgcatacagtgcggatgcctgcgtcagcgcatgctgaatcgattcgagcgactgctccatctgctgttgggcggcacgccattgttccgccaccgcattgaactgtgtggccgctccgcccctccagacgctctgcagattgttgagattggcgtacatgccctgcaccgactgacgtatcgcttggatggaggcgtttaccgccgcgctcgaggattgaatctgctcgctgtccacctgaaactgtgccatgatgatcctttcgttgccaggtacttttgtgtgctcggttggtaccgttctctcgcacttgacgtatctgaacggtaatgtggactgtatggcaacagtgaacgcgatgaatgaaaaaaccagggttgtggtcggaggatgtgcgaaaatgtgcccaatcggtgtgtcgcgacaacggcaaaacttcagaaatcgttggaatgtagcggcttgcatgcttctttctatgctgttgtgttgtgcgatgatgttgtggataactcccgtcggcagcgcggaagacaatacgggcaccggaatcacggccacggaaaatatcaccgacactgagaatctgctcggatcaaacgtcgccgagatcacggacgccatcagcgcgacaaagcaggaaacgggcgtcaccgtgcatttgctgtacctggcaagtttcaacaccgaagaaaaacctgcaaaatgggcgagcgcgctgttggaatcgcttgatccgaaaccgaatacggttttgctggcggtcgcttcgaacgatggcaatctcgtggttgccgtttcgtcgaattccgacgaatggttgaagaagaagtcgacggtcgatgcgctttccgatgctgcgcagaaacctttgatggaaagcactccggattggtcgaaatccgcaaccgatatgatggatcagattgcggtgcagaagaagacctcgacgtcgtcgcagaccgtgctgttgggtgttggcggcatgatagccgtgctggtgctgctgattgtgattatggtggtgttccatattctgcgcaagcgtggcatcatcaagcgcaaggtgcgcaagcatgcgggaaggcatgccgcgattactgtgcgttccgagccggtgaaggcgtggagtgtcgatggtgagctgtccgttgaagcgcatgatggagggcagacgtcaaaggaagactcagaatccgttcaggaaacatccagtgaacagagtgatgcttaaagcatgagcaagcctattgaagcatccattgtcgttgttgacgacgaaccgtccatccgtgagctgttggtggcatccttgcattttgcgggttttgaagtgaataccgcggcttcgggatctgaagccatcgaagtcatcgagaaaatacagcctgatttgattgtgcttgatgtgatgcttccggatatcgacggtttcacggtgacccgtcgtatccgtcaggaaggcatcactacgccggtgctgtatttgacggctcgcgatgatactcaagacaaggtcatgggtttgaccgtggggggtgacgactatgtgaccaagccgttcagtcttgaggaggtcgttgcgcgaatccgtgccattctgcgccgtacccaggagcaggttgaggatgatccgattatccgcgtcgcggatctggagatcaatgaggattcgcatgatgtgtcccgtgccggacagccgatcgatttgagccccaccgaatacaagttgctgcgttatttgatggataacgaggggcgtgtgctctcgaaggcgcagattttggatcatgtgtggcagtacgattggggcggggacgccgcgattgttgaatcgtacatttcatatctgcgcaagaaggtcgacggacttacggtggaggatgagaacggcgagaagcacaaggtggctccgcttatcgaaacgaagcgtggcatcggctacatgattcgtgcgccgaagaactaaacggtcccgcgatgagtcaggatacccgtcagccgtcggctgacccgcagaacacgcagaagaatggcggccagccgcgtccgcaacgtgtgccttggcatcggcggatcggcaggaaggtgcaggccattccgttaagcaccaagctggtcacttgcatcattgtgttgttgaccattggcactatcggcatttccttttccattcgcacgcttgtgggcaattatctgctacagaaaaccgacacgcagttggtgaatcaggcgcagatgattttcaatagcatggattcgctggacagcaccacgagcgaggatggccggagcttggtgaacacgtattatgtcgaggtgcgggacagcgaatacaagcgtaccggcgctgggtcggtgcctatgctccgtgagggcgtggtgtccgagccgagtctgccttccgacggcagtatcgacggggtcacgctcggagagccgttcaccacacaggcggtggtgcacgttaccaccagcagggtgccggatcatgccatcatgcaggccgcacagtcgccgtggcgtgttgtggcgctgccttggagcgagaaaaccaaaacggggcaggtcaaagacagcggcgtcgtgttcatcggattgtcgctgagtgaccagatcgacacgtccaacacgttgacgcggttctgtgccatggtcggcatcgcggtggtgttgatcggcgccattcttggtaccatcgtcgtgcaaagcacgcttgctccgctgaaacgtatcgagaagaccgctgcgaagattgcggcaggggatttgagccaacgtgttcccgatttgccggaaaatacggaagtcggatcgctgtccatgtcgctgaacaccatgctgacgcgtattgaggaaagcttccacgcgcaggaggaaacgaccgagaagatgaaacggttcgtttccgatgccagccatgagctgcgtactccgcttgccgcgattcacggatatgcggagttgtacaaaatgcagcgtgacatgcccggagcattggaacgtgccgatgagtccattgaacatatagaagcgtccagtgcgcgtatgacggtgcttgtcgaggatttgctgtcattggcgcggttggatgaaggacgtggcatcgatatcacccagcaggtgaagctgacttccgtggtcaatgatgcggctgatgatctgcacgcgctcgacccggatcgtggcatcacctgcggccaggtggtattgcaggcgggatcggatatggaacatccttcgcgtctcgccttccagccgggaaccatgccggacatcacgttgaccggcgatgcatcacgcttgcgtcaggtggtcacgaacattgtgggcaacatccatcggtacacgccggccgattccccggttgaagtgtccatgggcgtgcttccggcgtccatcagcccggaatcattgtctcgcatgccatccaacgagcagtcgttgcatcactttatcgaggccatcgaggtggggcaatccatgcaagtcggcatgaattacgcaattgtgcgattcagcgatcatggtcccggcgttcccgcagatgcacgctcgaagatcttcgaacggttctacacggcggatccgtccagagcacgacagaagggcggtacgggtctcggcatggcgatcgcccagtccgtggtcaaggcacaccatggtttcatctgcgcttccggcagtgacgggactggattgacactgacggtagtgcttccggtggctcctgtggaaccacgtccgttggcgcagaccagtgacgaacgcaaggtcgacaagcgtgggcgcaggccgaaaaaacaatgatgcaaacatgcaaaaaggcatgatctgacgattgttggcgcaagagatggttacatatcccacctcttgcgctaaactgtatctttgatttgtaatcggcggacgattgttctttcgttcgcctgaaggtatgtggattacgtaagagtgaggtgacaatgcctagcggacgcgttcgttggttcgatgcgaacaaaggctatggttttattcagaacgagcagggtgccgatgtgttcctgcctgcagccgccctgccggagggcgtgaagacgttgcgtaagggtgcaaaagtcgagtattccgtggtggagggccgccgtggtccgcaggcaatgggcctcacccttgtggcatccgcgccgtctctggtcaaagcaactcgaccgaagccggatgatatggccgccattgtggaggatcttatcaagctgctggattccgcggggaaccagttgcgccgccaccattatccgtctccggctgaaagcaagaaactggccacgctgatgcgtgccgtggccgataacttcgacgtacaggaataattcatgtccgataccacaatggatcccaaggcgatcgcccaggcggtggccatcgaagtcgccgatgaggatggccaagtcggtgacttcgtcgaagccatcgacttgggagacaacgttactgattttcgttttgaaacctgcatacgcgggtatgagggatggcagtggtcggtgacgttgtatcgcgatgctgagttggaccattggacggtcaatgagtcatcgctggtgcctaccgacaaggcgttgcgcccaccggaatggattccatggaaggatcgtcttgaaccgaccgatttggcggtgaccgattcgatcggcaccgatcccgatgatccacgtatggaagaggggttccgcagaactgagcccgttgagtctgccgaaagcgtttccgacgatgtgcagaccgtcgaagcggcggacggcggcgacaatgccggagcggacgctgacgtggttgacggttcgcaagacgagaatgccgtagcatcggtgacctccgaagaggacatcgacgaggcggttgaggaattcgatctgtcccgcaggcacgtgctcacgcctttgggccgttcccagaccgcgaaacgctggtatgagggaccgcgcggaccgaaatcgttgtccaccaaaacatcggatggcaatccatgctcgacgtgcggattcttcattcctctgaaaggcgaactgaatcttctgttcggcgtgtgcgctaacaagtggagtcctgatgacggtcgtgttgtatccatcgaccatggctgtggcgaacattccgaaatcgagccgccggaaccgtctcacttgtgggtgcagtcgaaacctgcatttgacgacctgcatatcgatatcatcgcgcaggcgccgcgtgatgaacgcggttccgtcgaactgatcgagcagctgtcggcgaatgaagacggcaatccgaacgatgaggaagaagcctccgaagccgatatcgaagccaataccgtggatgatgatgcgaatcaggaggaagtgctcgaacatacggcccagcaggatgagccggaggtggaatccaccgttgatttgagcgatgacgaagagccggttatcgtcgaatccgaagaggatgaagcgacggatgcggaacccaccgaagccgaggaaacggacactgcagaggaaaacgctccggaagctgagtaatcctgtcttatcgaggatatgaaagaagtccgttccctatgtaaggaagcggacttctttcatatcctcaaaggtttagtgcacgacagtgacggtgcagtcggcgaaattgacgatttgcttggagacggaaccaaggaaatgcgcgtccaagccggacaatccacgggaaccgaccactagatggcgtgcgtaacgggatgccgcgatcagccccttcgcagcggaaatatggaaggcgtgcgattcgatctggaaatcgtcgggaatgccggcagtgggaatctcaaccgaatcgagcagctcgtcaagaatgcgttccgcccgttcctgaccgacggcaatcggcgctatggcgttctcatatccctcgatgacgccaagatccttgagctgccagcagaacatcacctgcaggggagcgtgatgcaaagccgccaggtcgatagcgaatcgcaaggcgtgtcgcgaggtttccgaaccatcgacgccaaccacgatcggccgctggttcttaggcagaggggagccgggcaaatcgtacgtcaccgtgttctccgaaggcgtaagcgcgttggcgatggcatcctgcacgctggattcctcgtcgtcgagaatgcgaactatggtaacgggaacctgtgcggcttcggcaagcgattccgaaagcgagccgaggaaccagcgtgccactctgccgagtgaacggcgtccgactacgatctgctgcgcatccttgccgatctccagcaatgcggacgttcctgtggccttgaccgacgtgagtttgacatgatcctcattgatggtcatgccctgcgaagctttggaaacccagtcgcgaagccgttgcgcgatctcatggcggacttcggcccactgctcttcatcttccggttccgagcccatatcccaggaatgggaccatgcgaacaccgcattgacctgctggccggtaagcgatgcctcgttcagcgcccagcgtaatgcggcgaaggattcgtcggaaccgtcgacgccgacgacgatgtcgtgcaagcggatatctgcgagcatcccggattcggttgcatttagggtggtgtcgctcatcttggtgacctccttggtcgttgctatatgtcaagcatatccgttgcgttgcgtcgagagcgcaatttacgcgcggatgaaaacaaacgtcatcgcgaatcggtagagtgttgatggactaacaagagtggaaggacaagcatgttcgaacggtttaccgaccgtgcgcggcgcgtgatcgtgctggcgcaggaagaggctcgtaccctccagcacaactacatcggtaccgagcatctgctgcttggcctgattcgtgagggtgacggcgtcgcagccaaggcgctggcctcaaagggtgtgaccttggatgacacccgcaaacaggtcgaagagatgatcggtaaggggaatgccacgccgaacggccacattcccttcaccccgcatgccaggcaggtgttggagctgtcgctgcgtgaggcgttgcagctggggcacagctatatcggcaccgagcatatcctgctcggtctgattcatgaaggcgaaggcgtcggcacccaggtgctgatcaagatggacgtcaatcttggcgagctgcgcagcgccaccatcgacctgatccgtggcaattccggtgatggcaagggtgatggcaagggcgatttggccaatgccggtggcgtgcaggatcgtcgcaaccagaccggttccgcgattcttgaccagttcggccgcaatctgaccgctgaagctgccgccggcaagcttgatccggtgattgggcgttcgagtgagatcgagcgtgtgatggtggtactgagccgccgtaccaagaacaatccggtgctgatcggcgagccgggtgtcggcaagacggccgtggtcgaaggcttggcgcagaagatcaatgccggcgacgttccggagacgctgaagggcaagcaggtctattcgttggatctgggatccatggtggctggttcgcgctaccgtggcgatttcgaggagcgtctgaagaaggtgctcaaggagatcaagacccgcggcgacatcgtgctgttcatcgatgagatccataccattgtgggcgctggttccgcggatggcgctcttggcgcttccgacatgttgaagccaatgctcgcgcgaggtgagctgcagaccattggcgccaccaccaccgacgagtatcgtaagtacatcgagaaggatgccgctttggaacgtcgtttccagcccatccaggtgcatgagccgagcattgccgaaaccatcgagatccttaagggcttgcgttcgcgttacgagaaccatcaccatgtgacgatcaccgatggtgcgttgcaggccgcggccgatctgtcgagccgttacattcaggaccgtcatctgccagacaaggccatcgatctgatcgatgaggccggtgcgcgtctgcgcatccgtcgtctgaccgctccgccggagcttaaggaacttgacacgaagatcgccaagcttgccgaagagaaggaccaggccatcaagggccaggacttcgaaaaggccgctgagctgcgtgataagcaggagaagctggaagccgaacgcaagcagaaggaatcttcgtggcgtgagggcgaatctgatgtgaagatggttgtggatgaggatgtcatcgccgaagtgatttcccagaccaccggcattccggtgttcaagctcacccaggccgagtccaagaagctcatgaccatggaaagtgagttgcacaagcgcatcatcggccaggacgaggccgtgtccgcgttgagccgctccatccgtcgtgctcgtgttggtttgaaggatccgaagcgtccgtccggttcgtttatcttcgctggccccaccggcgtcggtaagaccgagctggccaagacgctcgccgaattcctgtttgacgacgaggacgcactgattcgtgtcgacatgtctgaattctccgagaaatatgcggcttcgcgcctgtttggtgctcctccgggatacgtcggttacgaagagggcggcgaactcaccgagaaggttcgtcgcaagccgttctccgtggtgctgttcgatgagatcgaaaaggcccatccggatatcttcaacacgctgctgcaggtgcttgatgacggtcatctgactgatggccagggccgcaaggtggacttcaagaacaccatcatcattctgaccaccaatcttggtacgcgagacatcgccaaggccgccaacaccggcttcaacttgggtgccaacaccgagtcgagctaccagcgcatgaaggatcaggtttccgcggagctgaagcagcagttccgtccggaattcctgaaccgtctggacgacatcatcgtgttcaagcagctcaccgagccgcaagtgcgtcagatcgtcgatcttgacgtcaagcagctcaatgatcgcttgttcgatcgccacatgtccctcgagcttaccgacgctgccaaggatctgctcgcgcagaagggcttcgacccgctgctgggcgcgcgtccgttgcgtcgcgtgattcagcgcgacgtcgaagacgccatttcggagaagatcctgatgggcgaactcgaagatggccagcgcgtgaaggtcgatgcggaaggcgaaggcatcctgggcgagttcacctttaccggtgaggcgttcgaagagccaaatacggagcctgctgaaggtgaagtcgcagctgaaaccgaggcacctgccgaatcgacggaatcgacagaacttacggaatccgcagaatctgttgaataagcaatcggtgcgtaagtaacgcgacacacgaaaggccttgaaatcgtatgtaatgatttcaaggcctttcgtatgccgaaagtatttcgaaacttgacgaattacagtgtcagcagatcgagatcggcagtgattgacgtgttacgggtgaacagtgtgcgaccctctcgtaccgagcgaagcacttcgcaacgctcgtatacggcgtcgaacacgctggaagcatcaagcacaatgaagtttgcgggcttgcctgcctcaagaccatacgaatcgcgcatgccgagcgtggttgcgccgttgactgtcaggaacttcaacgcatcatcgatctcttcaaaactcatcatctgcgccaaatgcagcacataatcgagaatcagcatcatattgccgttaccgaccggataccagggatcttgcatggaatcctgaccaagcgacacattcaccccagcttcggtgagctccttgactcgcgtgatgccacgacgcttcgggaacgtgtcttgacgcccctgcagatacagattttccgtaggtgcgcaggcgaaattgatatgtgcggccttcaacagcttggtcagatggaagaaataggcattgtcggccgatcccaaggagcaagtgtggcttgccgtggtcttcgaaccgataccggcgcgataggcgagtgcggacagcagttcaagataacgtgagtttggatcgtcggtttcgtcgcaatgcacgtcgatgagcttgtcgtacttcgaagccagttcgaccacggtgtgcatggaacgttcgccgaactcacggcactgctcgaaatgcggaatgccaccgacgcaatcagcacccattttcaggccttcctcaaccaaatccgcgccggattcgccatgaggaccttcataggagtacatgccctcctgcgggaaggagacgatctgcagcgtgacagtatctttcagttcctccttaagctccagcagagctttgagcgaggtaagattcgggtcggtcacatcggcgtgtgaacgaatgaactgcacgccatgacgcatttccttggcgatgccgattttcgcgcgttccttgatctcgtcgacagtgagatctgccttggtttcactccaacgctgaatgccttcgaacagggtgcctgactcgttcaccgcgccgggcttgcgtgcggtaaagacgtaatcaagatgcagatgggtgtcgcagaatggtggacagaccagctttccgcccaaatcgacgacttccacgctcgccatatctttgccttgtgcttcgagtgttgctttgagatggggtgcaatgctgatgaacttgccgtcttcgacgagaatatcttggattgccgctgtttcggctgcggtgctgcccggcatgccggtggcgatgtgtgcgttgatgaacagttgcgtgctcataatcactccttccaatacgagttttcatgcgagttttcgggttccggcagacgttttgtcatatgtccattgggttacggaagggaacctttgacgtaatcgttgatggttattgtcggcgtattgctttgcggtcacgttacttgatgtgacatgtgtattacttcggattggacggtttgtatggctgttacggtgagggaagtgctcgatgatgccttggttgcgacggcggaaccacaggttgaagttgctggcgatagcttggataatccggtgcgttgggtgttcaccaacgaacgcgaggacgtcgcctcatttctggcaggaggcgagcttctggtggtggaggggcgatctttagttgcggacggtcgtgaaaaacgtgcggacgaatatgtgaaaagcctcgtgaatgctgatattgcggcattgatggtcgaattggttgaagaagtcacccaactgccgaaaatgttggtgaaggcagccaagcatgaaggacttacgattattggattgcgccgtcgcattcctttcgtcgatatctgccagagcgtcaataccatgattgtgcgtgatcagatgcgtatgcagatgcaagtggacgttatgtcaacttcgttgcgttctgagcttgctcaagcgtccaatcccaaagccgttgccgatggcattgcgaacctgttcggcgaggatgtggtcatattcgacgtggacggtcttgaagtcgcccgagccggacagaacatcaataccgctacagattgcggcattgtacttgcactggaggaacagaaacggcctttgggcgctttggagatcagccagcgcaatacggtgttcgatgaagcgatgtgcagaaggatcgaacagattgccgctccggttttgacactgtatctcgatgggggagcgcgcgtcggcatggtggcgcatctgattgcggggccggaagatggcgtgcatgtttcgccgatggaagcgcgtgagggccatgccatgcttgatgcgttgggattcgccgcttcgggcgtgtatatgccatttgccatgaaactcaagtcggtggccaacgccatgccggcaatcgtgtcgatgatcgacgatttcgaatccaacggcggttgcgaatcgatctgtttgttggaaggcgatttaatgatcggttttctcgcggcgcaagacagcggcggcgatgtgttggtattttcagatcggtgtttgcatgcgttgacgcaagtcgctgcaaacgaatacgtatataccgtgcatggacgcgcagcgttggacacgatttcattgatggacgcgttcggtgcgttgcgcagtgtgattcgaacatgcatttcgaacgatgcggaatgcccgtatggaaccctcgaatgtgtggattcctcgttgctggaacgcatgttgggaatggaacgtaccgatgaggccgtgcgcatggtgatcacgcagacggttgggcatgagcttatgcataacgccatgctgatcgacacgttgtgcgcctgtttcgacaatctcgacaacaagaccggcgcatgcgagcaattaggtatccaacggcagacgttgtacaaccgattggacaaagtgacacagatcgtaggcatagcgcctaccgataaaatcagctggtcaatgctgcttttaggtgcgaaaatggcgaaatcgcaacataatcacaccatatcttccacttcggcgctgtaagcaaggggaacttggcaaaacgtcaaaaacaaacggttgcggtttaacaatcagttcactttggcgcaaatacttcgggcgatagtcagagtcacaacgttcgccgggtatgaagaaaacgcgaacgtacagacagattcagcagaagaaagcaggtgacatgatgagtgccagtgcaacaatcgcaaccgccaacagggcttccgtgtctgaacagtccgaagagcagaagatggtcaagaaagtggccgtctcgtctttcctcggcaacttcattgaatggttcgactacgcttcctattcctacttcgcgaccaccatcgctttggtgtttttcccgtccggcaatcacacggtcgccatgctgcagacgttcggcgtgtttgcactgtcattcgtgcttcgtccgatcggtgcactgttttggggtaacttcggcgataagaagggacgcaagggcgctcttgcgatttccatcatgttcatgtcgggtgcatcgttcctgattggctgcctgccgtcatatgctgcgatcggcattttcgctccggcactgttgctgctgcttcgcatggtgcagggcttctccgcttccggtgaatatgccggcgccgcaaccttccttggcgaatacgcgccgaccaagaagcgtggcatctactgctcgctgattccggcatccaccgccatcggtctgctcgtaggctccacgctcgccaccgtgatgaccgcttcgctgagctctgatgcactgacctcttggggatggcgtattccgttcctcatggccggcccgcttggtctgatcgtgcatttcatccgtaccaagctcgctgattcgccggtgtatgcttccatgaccgaagctttggatgacaagcagcagttcgcttccaccactaagagcgtctccccgctgcgcgagctgttccagaaccacttcaagactttggtcatcagcttcggtgcctgcgtgctcaacgcggtcggcttctacacggtgctcacctacctgccgacctatctgagcgacacggttggcatggctgccgcacagtcgtccaccatcaccaccatctgcctggtactgtatgtggctttggtgttcggcatgggtcacatctccgacatgttcggacgcaagaaggtgctgattggtgcatgcgtggccttcatcgtgctcaccgttccggccttcatggcgctgaacaccgcacagttctggccggtgctgatcgttgagctcgccatgtgcgccaccctgaccgccaacgacggtacgctttcgagctacctgactgaaaccttcccgacatcggttcgtttcaccggcttcgcattcagcttcaaccttgccaacgccatcttcggtggaaccgcgccgttcatcgcaacctggctgatctacaccaccggttcgagcatcgctccggcctggtacatggtggcggtggccgccgtggcactggtcgccatgatcctctctcacgaaaacacggataaggatctgagccgcatctgagaagaaacggtttttacgaaacaattcctcgaaacaataaacgccgtccctgaaacatcgattgcaacatcgattcgcggggacggcatcatcgcaatcattatcaattgttgaaacgcaaaccaacaacagcacataaaggagcaatcatgagcagcagccgtcggatggaccatatgacctggccggaaatcgaagcatcgaaatcaaagccggttattgtgccaatcggctccactgaacagcatagccagcatcttccccttggtgtggacgccatgatcgccagccatgtgtctgaagacctcgccgaacgcatcgacggcatcgtggcaccgaccatgaactacgggtacaagtcgaagccgctttccggaggcggcccattgttccccggcaccatcgacatgaacggtgtgacggtgatcaatcaaatgcatgatgtgcttggcgagctgatcgcggacggtttcaccaaaatcgtggtgatgaacgcgcatttcgaaaacgaggcattcattatcgaggcaatcgatctgatcacccgcgaaaccaagggagtggccaccatcgtcgaaaccaactggtgggatccgctgccggagaacgtggtcgagcaggtgttcgacggactcgtgttccccggttgggcgttggaacatgccgcagtgacggaaacctcattgatgatgcattacgagccggaattggtgcatatggaccgtgtgattgacgaaggcaatgtcacaccgaaggcttacgtgcgctacccggtgcgcaagggcgacgttccggattacggaggactggccactcctgcaggttccagcgccgaacgaggtaagctcatcgtcgatgcctgcattgatgcggtggccgatatttgtgctaccgaattcggcgaatgatagttgaatattctgtatggtgattgcgcatgtgagaacacgtgcgattatacgaagaaggctggtatgtgacggatgtcgttacgtaccagccttcttgattatgcctgagtgaagtccagctgatatttgaccgcatctctgtggtgcaaccaaatatcaggatgtgcgacttacttgatggcgttcagccactgttccttggtggccttctcggattcgagcttggccttcttcttcggatcggattccgcggcgatcttctgatcaagctcagcgagctgagcgttgagctgttcttcgaaggaggacttgcgggcgtcggcttccggatcggactgcttccaagcggcatcctcaatggccttgatctgcttgtctacagcatcgagacggccttcgatgcggcgcacttcgtcacgcggcacgtaaccgatctggtcccactcctcctgaatggcggcgagagcctgacgggcctgcttggcctcttcttcgctcttgacgggaaccagcgcctcggccttgaccagcagctcttccttcttggcaagattttccttctcggaggagctgatctgatcacgatcggcctgacgtgcgttgaagaaggtgtctgcggcggcgcggaaacgctcccacatggcatcatcgtcacgacgaccggcacgaccggccttcttccaacgatccatcagctcggtgaacttgcgggaggtttcaacccaagcggtggaatcctgcagcgcctcggcctcggcgatgatggcttccttggtggacttggcggaattacgctcttcgtcacggttctgcacccacttgcggcgggcgaaattgaacttggtgcgggccgcggagaaacgagcccacagggcgtccgcatcttccttgtcgatgcggacgttgttgcgctgatgctcctgccactgctggaagagcgaacggaacttgtctgcggtggaacgccagttggtgttctcgtcgagggaatcagccagcgcctcggccttctccacaatggcggtgcgctcctcgacggccttggcgatagcggccttgcgtgcctcggtcaacgcggttttcttggctgcgccttcctccttcagcgcctcgaactgggccttgagagcggccagatcacccaccactgccggctgttcggtttccgcggacagcgtcttgatggtctcgtcgatttcgcgggacttcacattgttggacttgagcttgttcgcgaacaggtccaacttggccttcaaatcaaggtaacggcgggcatacagagccagcgcctcttccttggaggcatcagggaactgaccgacctcacgttctccttcgccgtccttgacgaacacagtaccatcgtcggcgacacggccgaatgcttcggcggtcttcacatcggcatcggagaagccggtggatgcggcagccggagcggtgtgctgtggagctttcttggcgaaggccgcggggctcggagcatggggcttcatcgaagccgggctcggaacggccggtttgctggccttgactgcgggcgtcgttgcctgctcggtggtttcattggtgttctcggacgcggtgacattctcgtcggccatggccagctcctttaagtaagcttcatgtagtgcaggggatgcggatcgtgcgaacgtgctttcaaagcctgaaaaacgcgctgcattttccgcaacctcatttattatagggaatcgtggcaaaaggcgcatctatttcaggatttccagagtggctcccctctgaacgtgttgtggagcagcgtgttatcgacacgctccgtgaagttttcgagctcaatggcttcattggcattgaaactcgtgctgttgagcagggttcgagtctgctcaagaagggcgaaaccagcaaggaaatttacctgctgagccgccttcaggaggtcggtcatgagtccgacactccgattgaggaccgccttggtctgcacttcgatttgactgttccgctgagccgttatgtggtcgaacattccggcgatttggcattccctttcaagcgttggcagattcagaaggtctggcgtggcgaacgcccgcaggaaggtcgtttccgcgagttcgtgcaggccgatatcgatgtgatcggcaacggtgatctgcccgatcattacgaggtcgagctgccgctggtcatggtatcggcattggaacgtctgcgtgagttcggtttgccgaaggccaccgtgcatgcgaacaaccgtaagctttctgaaggtttctaccgtggtcttggcttgaccgatgtcgagggcgtgctccgtgagatcgataagctcgacaagatcggtgccgacgaagtggccaagttgctggtcgaaggctgtggagccgacgagaatcaggcacgtgcgtgccttgagctggctgaactgaccgcagctgacggcgctgaactgtccggcaagttcgacacgctgtgcgagaagcatggcattgccaatgattccgaggcgtacgtgctcgcacgtcagggtcttgacacgttggcgatgattgttgacgaggccgctcgtattcgcccgggctccgtgatcgctgatttgaagatcgcgcgtggtctggattactacaccggttccgtgtatgagacgttccttgacggtgctgcggctcttggttccatctgttccggcggtcgttacgacaatctcgcatcgcagggcaacaggaagtatccgggcgtgggcctgtccattggcctgtcccgcttggtttcgtacatgctgcacaccgccggtgcccacgcgaatcgcgtgtccccggcttccgtgctcgtggccgtgtggaacgaggaggaccgttccgcttccaaccaaatcgccaaccagctgcgcgcccgtggcatcgcggcagatgtggctccgaccgcagccaagcttggcaagcagatcaagtatgccgacaagctcggcatcccatacgtgtggttccccgcggacaagtccgcgcaggacgcttcggacgaagtcaagaacatcatcacgggcgaccagcagccggccaacgcacagtcttgggagccggatactgtgtatgcccagcaaaccgttaccgtagaagcctgaaatcgcaagacttcaatcattagagaacaaggaataggggaagcatgagccagacggcttatagaacacatcatgcaaccgaagtgaccgaggaactcgtcggtcagaaggtgacgctctccggttgggtcgatcgtcgtcgtgaccacggtggcgtggccttcatcgatcttcgtgacaacaccggtcttgtgcaggtagttatctacgacgaagacatggcacgtccgctgcgctccgagtttgtgattcaggtggtgggcgaggtccgcctgcgtccggacggtaacgagaatgatcatctggccaccggcaagatcgaggttgtggcggaaaacatcgaggtgctcgccaagtctgacgcgctgccgttccaggtgtccaccgcgttggaaaacgagtccgagaacaagctgccgggcgaggaagttcgcctcaagtaccgttatctcgacctgcgccgcccgtccatgcagcgcaatctgaagctgcgttcccagatgtcgaaggctgctcgccacgctctggaagagatgggcttcgaagaggtcgaaaccccgaccatgatcaagtccactccggaaggcgctcgcgattttgtggtgccggcccgcttgatgccaggttcttggtacgcgttgccgcagtccccgcagcttctcaagcagctgctgatggtttccggcgtggaacgctactaccagctggcccgctgctaccgtgacgaggatttccgtgcagatcgtcagccggagttcacccagctcgatatggaaatggcgttcgtggatcaggaagacgtgatggccatggccgaaaaggtcatcgccgccatctggaagtccgcaggctatgagatccagctgccgattcagcgcatcacttggcaggaagccatggataagtacggttccgacaagccggatctgcgtttcggcaacccgctgatcgagctgaccgactacttcaagaacactccgttccgcgtgttccaggctccgtacgttggtgcggtgctcttcaagggtggcgcggccacgcctcgtcgccagttcgacgcttggcaggattgggccaagcagcgcggcgccaagggcctcgcctacgtggtgttcgctgagaacggcgagctcaagggacctgttgccaagaacctgtctgaagaggagcgcgctggcctgaaggaagccgttggcgcagaagacggcgatgccgtgttcttcgcagcaggccgtcgcacctccgctcaggagctgctgggtgccgtgcgtgtggaactggccgatcgcgccggtctgctcaagccggacgacttcgctttcacttgggttgtggacttcccgctgttcaagcccaccgacgatccggatgacgacgatgtggcagtcggccactccaagtggacctccatgcaccacccgttcaccatgccgtccaaggattggatcgacaccttcgacaaggatccggaacacgccatgtctgattcctacgacatcgtgtgcaacggtaacgaaatgggcggcggttccgtgcgtatccaccgtgatgacattcaggatcgtgtgctcgatgtgctcggcatcactcctgaagaggctgccgacaagttcggcttcctgcttgaagccttcaagtacggcgctccgccgcacgctggcatcgctctcggttgggatcgtaccgccgccatcctggctggcgccgactccatccgcgacgtcatcgccttcccgaaggctggcggcggtcgtgatccgctgaccggcgccccggctccgatttccgacgaacagcgtgcggaaaccggcgttgattatgatccggaagaagacgaagactgatagtgttttcgctttgagataacaggctgtctttgcatgagagaccgtgcaaggacagcctgtttttattgtttacgttgtctattttctcttgctgccggtatagtggagcaaagatgagtatctgaaatattatgagaaagaactgaatctgtagtatgaatttgaagcaatcgttggaaaaacatgattttcatggtgtctggatgcgacttctcgcgttggcgatgatactgattgtggcagtgagtgcactcatcgcatccccagttagtgctaacgccgccgaagtcggagatccctccgcagtcaagggcaaaacctacgcggtcggcaccgataccacattcgcaccgttcgaatatcgcgagaacggcaagatgaccggtatcgatatggaactgatccgtgccatcgcccaagaagaaggattcgaagtcaccatccaatcattgggtttcaatgcagcattgcaggctttgagctccaatcaggtggatgtggtgatcgcaggcatgtcaatcaccgacgaacgcaaggcgacctacgatttttccaatccttacttccagtccggtatccagatggccatcgctgaaaacaacgatagtattaccagctacaaggatcttgacggtaagaccgttgtcgcgaaaaccggatcggaaggcgaatcctacgccaaacagcatgcaagcgaatacggctataccgtgacttccgtggaccagtcatcaaccatgtacgagatggtcaaatccggcaatgcggatgccgtgttcgacgactatccggtgcttgcctacggtgtttcccaaaacaacggtttgaagatcgtgactccgaaggtgccgcatggtgaatacggcatggccgtgaacaaaggcaagaacgccgatctgctggccgccatcgacgatggtctgaacaagctcatcgcttcgggcgagtatgagacgattgtcgcacagtatttgggtgccgatggcgcgaaggaacaggtcgaggcgatttccggcaaggtcaccgacaacggtgccgacggtgaggcgcagaagaaggtcggtttctttggtctggtcaaacagtcgatgccggctttgctgactggtctgaagaacacgctgttgatcacgttgctgtcgtttgtgatcgcactggcgttgggtgttgctttcggcttgatgaaagtatcggagaacaagattctgagaggcgtgtccaaggtttatatcgcagtgttccgcggcactccgattctggtgtgggcgttcttcttctatttcggtgtgccgcagcttatcggacacagtgtgaacatttgggttgcaggtgcgttgacgttgtcgctcaattccggcgcatatctggcggagatcgtgcgtggcgccgtgcagtccgttgactctggtcagatggagggagcacgctcgcttggcctcaaccatcatcaggccatggcgcgcgtgatcatgcctcaggccactgcaatcgccatgccgtcgatcatcaaccagctggtcattatgatcaaagattcctcgctgctgctggccatcggctttggtgaattgctgtatcaggcgcagcaattgtatgcggcgaacttccgcgtcaccgaaacgttgctgatcgtcggtgtgatgtacttcgtggccatcaccatcctcacatggctggccaatatcgttgacaggaaggtgaatcgatgagcgagaactgcaatcacggcaacaatgatggcgaagtgatcatcgacgtcaagaatctgcataaaaactatggtcatatggaagtcatcaaaggcgtcgatcttacggtacgcaagggcgaggtgatctgtatcatcggaccgtctggtgccggcaaatccaccatgttgcgttgcctgaacggacttgaacaggcatccagcggccagatcgtggtcaacggtcatgatctgggtgatccgcatgtgaacatcgaccaggtccgagagcaggttggcatggtgttccagcatttcaacctgttcaacaacatgagcgtgattgacaacatcacgcttgcgccgaaactggtgcacaaggaaaccgacgagcaggcgcgtgaacatgcgatggcattgctgaaaaccgtgggattggccgaaaaggccgatgtcatgcctcgctcgttgtctggcggtcaaaagcagcgtgttgccatcgcacgatccttggccatgcgtccgaaggtcatgctgttcgacgaggccacgtcggcgcttgacccggagatggtcggtgatgtgctcgaagtcattcgtgagctggccgaagacggcatgaccatggtgctggtgacccacgagatgggtttcgcccgcgaagtggccacccgcgtgatcttcaccgacgccggcgtgatcgaggaggaaggcactccggacgagatcttcaaccatccaaagagcgaacgattgaagacgttcctttccaaagtgctctgagtgctctcttggccccggcgattgcttaatcgctgatcgcggatgaaatgctgcgatcgtgtgacggatggtcatacgaatctgcatgtaaaagacaggcgaatgtagggtgaaattcatcttgcgttcgcctgttcggctctttctcgttgcttggcgttcctacgttggtatgcatgagcattggtgatacgtggcgtcgcgttgtggatggtttcaaatccaaggtgcccgaacgagtggtgttcggtgcggtggttgtattgttcgtaatagcggtgctggctatcgaattgccacgatggtggtagctgccacgtacggcgctcaagatatcggtattgcggtcgataacgcgctatgatgcattttgggacaacgttgtctcatatttcgagcacgtcagggggtggtgacggccgcggaaacatggctttcatatactatccgtatgacagatatcaaagaaacgcaagagacgcgcccgatcatgccgggtacggaagacagcgaccgcccgctggtcgaattgacccacgttgaaaagcactacggtgacttgcatgtgctcaaggacatcaacctcaccgtcaagaagggcgaggtgctggtcatcgtcggtccatccggttccggcaaatccaccatgtgccgcaccatcaaccgtttggaaaccatcgattccggcgacattcgcatcgacggcaagccgttgcctcaggaaggcaaggagctcgccagcctgcgcgccgaggttggcatggtgttccagtcgttcaacctgttcgccaacaagaccattcttgaaaacgtgacgcttgctccgatcaaggtgcgccatatggataagaaggcggccgaggatctcgccatggatttgcttgcccgcgtgggcgtggcttcccaagcctccaagatgccgtcacagctttccggcggtcagcagcagcgtgtcgccatcgcccgagcgctcgccatgcagccgaaggtcatgctgttcgacgaaccgacgtccgcacttgatccggaaatggtcaacgaagtgcttgacgtcatggtggagctggctcacgaaggcatgaccatgctgtgcgtgacccacgaaatgggcttcgcacgcaaggtggccgacaaggtcgtgttcatgtccgacggccagattcttgagcagagcacgccggaggacttctttgaaaatccgaagaccgatcgtgccaaggacttcctgtcgaagattctcacccactgaaatgactgacgggaataagacagaagaaggattttcgatatgaaactttctatgagggcgaagcgtatgctacgcagggttatagcgactttctgcgcatgcgcatgcgtgttcgcagtgtccgcctgtggcgcggacgacgccgatggcaagattcgcgtcggtatcaaattcgaccagcctggtctgggcttcaaaaagtccggcacgtatgtcggcttcgacgttgacgtagccaagtacatcgccaagaaactcggctattccgaagaccagatcgtgtggaaggaagcaccgtcgaagcagcgtgaagccatgctgcagaacggtgacgtcgattacatcgtcgccacgtactccatcaccgacgaacgcaagaaggtcgtctccttcgccggaccgtatttcgtggcgggtcaggatctgctcgttcgtaaagacgaaacctccatcaagggacctgaggatctgaacggcaagcgtttgtgctccgtgaccggttccacttccgcggtcaccgtcaaggagaagttcgccaacgaagtgcagctcatggagcagcctggttacgcggagtgcgctaccgcactgttctctggcattgttgatgcggtgaccaccgacgacattattttggctggtcttgcctccgcgtcccgcggccgtctgcgcgtggtcggcaagccgttcacccaggagtattacggcgtcggcatcaagaagggcgatacgaagctggccacccagatcaacaacgccatcgccgatatgatccaggatggttcttggcagcgtgccatttccgacaacacgaagggcaccgcatacacgccgaacgcgaagtacaatccgccggagccgactgagggggagagataatggaagcgttcatctcattgttcagccagtacaatgtgccggctgcgttcttggtgaacattgaactgaccctgtggtcggcgttgttctccacgattcttggcgtcatcctcgtgatgatgcgcatctcgccggtcgcgtcgctgcgtatggtctcgggtgcttacgtcgagctgttcaagaacctgccgttgaccatcatcatggtgttcatggtgctgggtgcctacgcgcagctgaagctcagcttctccgacacgttcgccaccaacttcttctggcttgccgtcaccggtttgagcctgtatacggcggccttcgtgtgcgaatcgctgcgatccggcatcaacaccgtgccgcttggccaggctgaagcctgccgtgcgctgggattgaacttcatgcagtccgccacccagatcattctgcctcaggcgttccgtggctccgtggcaccgctgggcaacacgttgatcgcattgctgaagaattccacggttgcggccgcggcttccgtcgccaccgaaacctcgtcgttgatgagcgaaatgatcgaataccgttccgacgtgattgttccgatcttcctgatcttcgcattcggttatgtgattctgatcattccgatcggcatgctgaccacgtatctgtccaacaagctcgcggtgaggaggtgacgcaccatggcaagcgatgaaagcgcggtgctgttcgaccagcccggtcctaagacccgtaaaaccattcgtatcgtcaactggattgccggcattgtcttcgcaatcgtagttgtgctcattctcatgaggcttcacaatccgccggatggcgagaaccagctgagctgggagttgtggaagccggcgcttgacgctgaagcatggaccgatttctatctgcccggattgtgggccacgattcgagcttccgtgttggcagtgatcggcgcagtgctgttcggtctgattttcggtatcggccgtctgctgccgaatatcgtgattcgtgcgatttccggcgccatcgttgagttcgcacgtgcggtccctgtgctgctgctgatgatcttcttctggcgttggttcgctttcgcaggcatgtcaagccccgcatactgggctgtggtgctcgcattggtgatctacaacggttccgtggtggccgagctggttcgttccggtgtcggcaacctgccgaacggccagcgtgaggcgtcgctcgccttgggcttgacccgcacgcagtcgctgatggaaatcgaagtgccacaggccatctacgccatgcttcctgccgccgtgacgcagttggtggtggtactgaaggataccgctctcggctcgatcatcatgtacaccgatttgctgcaggaatcgcgtcgacttggttcgatgtacttcaatattctgcagacattggttgtggctgccgtcatctacttcatcgcatgctggctgctgagccgtcttgcggaatggctgccggaacgcatgcagaagcacactgcggcacctgccgaaccggaaccggtcgctccgatcgccattatggatccgtcgaacgtgaaccagatcgccgtggctagggaaggtgtgccgcttggcggtgcccagcgcctgtaccatgtgcaccatcgtggttccaacgcgtcgattcgccattggcgtcagacccgctatgttcagggattcgatgagacgcatccggaaagccaagtcgagttcgataagaatggcaggccgatcaaagatacgtccaagcaggacaagctgagattcgacaagccgaagtcagacaaatcaaagggtgataagcccaagcagtgacgtcatttgatctgagaagaccgatagggcgctggtttcttgcaaagagcgaggaatcagcgccctattgcgtgaaagaagtcagacaaaacgtcagaaaagcgggatgcggcgattaggtgcggcgatgccacggttcaatcgccgcatcgtctatcataggggacaagcgaggaggcttgacatgtcagacaaagacaaggatgcgaagacgtcgtccattgcgaagacgttgaacaaggttgaggacaggcttgagaagggggagaactgcagttccgttgccgaagggcttgcgaatgttgccaaggccagcgagttgctcagttccgtgtggacacttccgcccagtcagttattgcgattccatcatgatacgagggtcgctgcaatcgatggcgattccacgccgggtttcgacggcaacaaagatgatgcggaacgattcattgcgatcagttcttctgaaatcgcacgatatcagcggcttatgtacgccaatggagtgaaaggttcccgccgtcgtctgttgattattctgcagggcatggatgcttccggcaaaggcggcatcgtgcgtcacgtattcagccagggcgatccgatgggcatgcattatcacggtttcggtgctcccaaaggcgaggaaaaggaccacgattatttgtggcgcatcaaacgggaactgccgcagaatggttggatctccattttcgatagatcgcactatgaagatatcgtcatgccgcgcatttacaaaacctatccggaagaggtatggcaggcgcgatatgacgaaatcaaccgattcgaatcgcaattggtcgcggacggatgctccatcatcaaaatattccttgtggtgagcaaagaggagcagaaggagcatttcctcggcagactggaggatccgaccaaatattgaaagttcgaccccagcgaccttgaagcgcgtgcccgttggaacgactacatggccgcatggcaggacgtgttcgcgcgtacgagcaccgagcaggcgccctggtacctggtgcctgccgacaatcgttggtattcaagggcggttgtgtctgaactgctccgtaacgtattgaagaacatgaacatgatctggccgcctctggaagtcgacgccgacgagatgcgacgtcagttggaaacgctgtagtcgaagaacacgacttcgccgctcgactgtgtggtgtccaaatcgacggttccggtgatggcccaatcatggtcgccatcggaatcgtcgatgatctgacgcaccttccaactgtgctcgctgttctccttggaatcgtcgaggatgaacagttcgctgctacgggccttcgcatccgtgttgacgtattcgtgctcatcgtagaagtcgtcgagcgcatcctcccattcgtgcacgccataaccccagtctttgtcaagcgcgccgagctcgtcgggtttgtcgagatccatgagctgcacgcggcggaacatggcgttgcgcacgagcacggtgaggcctcgacgatcctccaccacggcctgcttcgcgccgggtgcggccaggttcgcggcggcttcggaagcgtcggtgccggctcccgcgttctcccattcgtcgaccagcgaggagtcgatggaacgaaccacaacgcgcagccaggagatgatgtcccgtaactgttcgttgcgcttctccaaaggaacggtacgcgccagcgcgcgatatgcgtcagacagatagcgcagcagcgtgccttcggagcgggcgatattgtagcgcgcgatgtaaccggtgaaatcggaggccgtttcgaccatgtcccggatcaccgatttcgggctcaaccaataatcattggcccaaggcacatcgtgacggtattcgtcgaacgcagcctgaagcatgtcttccaatggtttcggatacgtgatctcctgcaagcggtccatacgttcgtcatagtcaagaccgtcttccttcatgcggatcatcgccgcgtcgcgggcttgacgttcctgcgcgcgcaacacctgcttcggatcctccaacgtggcttccaccatggaaatcacgtcaagcgcgtaactttccgattccggatcaagcagttccaacgcagccagcaggaacgggctcaacggctggtcaagcgcgaaatcatccggcatgtcgacggtcatgaaatagtccttgccaccatcatcgcggtcttccgtttcgatcacattcgtgtcgaacaaggtctggaagatctcgtcggcacgatcatgaagacgctccttctgttccggagtctgcgctgaatcatcgatcaggcgatcgatgcggtagcgtgcgtcgccgccctgcgccacttcgttcaacaccatggaatgcgtgaccttcatatgcggcaccaaagtttcagggtccgcgtcgatcagcttatcgaacgtgttctcattccacgtgacgaagccctcaggcgccttcttgcgcttgactttcttgagctttttcgggtcgttgcccgctttggcgagggccttggcgttctcgatttcgaattccggaccctcggcgatgaccaagccctccgtgtcgaagcccatacgtcccgcacgccccgcgatctgatggaattcgcgggcacgcagcttgcgcatcttcgtgccatcgaacttggtcaatgcggtcaacaccacggaatgaatgggcacgttgatgccgacacccaacgtgtcagtgccgcagatcaccggaagaagaccctgctgggcgagttgctcgaccagacggcgatagcggggaagcatgcccgcatggtggatacccacgccggtacgcagcagacgctgcagaatcttaccgaacgccgtggtgaacttcgtgcccttgatcgcctccgcaatggccgcacgttgctccttgctggacactcccgtgctcgccagagcgttcgccgtctccaatgcggcatcctgagagaaatgcaccacatagatcggcgtttcccctctgccgaaggccagttcgacggttttctccaacgggtcaagcgtgtactcgtacgtcaacggtaccggacgcggcgcatcggcgatgatgtcgacgtccgtgtccgtcatgtcctccaatttgtcggcaatcgcatcgacgttgcccaatgtggcgctcatcagcaaaaactgcgtgttcggcaatgtcagcagcggaacctgccaagcccaaccacgctccgaatcgccataataatggaattcgtccatcgccacacagccgacatcggcatgacggccctcacgcaatgcctggttcgcaagaatctccgcagtgcagcagatgatcggcgcatcggcgttgatgtgcgtgtctccggtgatcatgccgacgttctcacgaccgaacacctccaccaaatcaaagaatttctcagacaccaacgccttgatcggagccgtgtaatacgagcgacggcccgtgcacaacgcagcgaaatgcatacccaacgccaccagtgatttgccggagccggtgggcgtgttcaaaatgacatgatcgcccgcgagcaggtccatgatggcctcttcctgatggggccacggctcaacacctttgacgtccgccacccactcgaaaaagcgttcgtagatctcgtccgtgtcgatgttgcgctcgccatcgctccaattcggcgccaaggcgcccaaagaaccgtaattcgtatcgtcagccatgattgccagtctagcggctggcatgaactcaaatgtcgaacgtgtgttcgaattattgcgtatgttgcggtacagtagaaattatgactgaggatttgtttggtgcgatggacgctcccgaagatatgacacgcccgctggccgtgcgcatgcgtccgtcgagcgtggacgaagtggtgggccaatcgcgggtgctgggacagggctctcctctgcgcagactcgccaatccggcgtccaaaggctcgctgaccgcgccgagctccattattctgtttggacctcccggcgtcggcaagactacgcttgcctatattgtggccaaacagtccggtcgagtcttcgaagagctttccgcagtcacctccggcgtcaaggacgtgcgagatgtactcagacgcgcccatgatcgtcttgtcgcggagggcaaggaaacggtactgttcatcgacgaagtgcaccgattctccaaatcgcagcaggatgcattgctgccaagcgtggaaaaccgtgacgtcactttcattgcggccaccacggaaaatccgagcttttccatcatcaaaccgttgttaagccgatccgtggtcgtcaaactcgaatcgctggaacccgacgacctgaaaacgctcatcaacagggccatcgaaagcgagcgtgggcttaaaaacgaagtcaaaatcaacgacgaagccgttgacgaaatcgtgcgtatggccggaggcgacgcgcgaaaaacactgacgatccttgaagccgccgcgggggcgcttaccggagaccaagcgcgcaaaaaaggtacgaaacggccaatcatcactcccgacgtggtatcgcaggtcatggacgtggccaccgtgcgctatgacaaagacggcgacgaccattacgatgtgatttccgcattcatcaaatccatgcgtggatccgacccggacgccaccatgcactacttggcacggatgttgcgcgccggcgaggatccgcgattcatcgcacggcgcattatgatcgcagcttccgaggaagtcggtatggcggctccgcagatactgcaggtcaccgtcgcggcggcacaagccgtgtccatgatcggcatgcccgaggcgcgcatcattctcgcggaagccgcgctcgccgttgccaccgcgccaaaatcgaacgccggctacaacgccatcaacagcgcgctcgccgatgtggacgcgggattgatcggtcaggtacccttgcacctaaggaatgcgccgaccgccctgatgaaaagttggggcaatcatgaggggtatcggtacgctcatgattggccgggagccgtggctccgcagcaatacatgccggacgagctggcagggcgggaatactaccatccgaacgatcgcggctacgagcatgagatcaaaccgagactggagaaaattcgcaaaatcctgcatgagaagaacggtgataggggctgatcgtttcttcccgccgctgacgagttcacccatatccgtgtacaatgctgacctagtgaacgttaacatacgttcgtgctcaacgtggagggcgagtctgggcaaacttggacgcagtgttgaagggaatgacgaagcaatgcgaaatatgcaggatgagtctaatcaacgattgatcatgatcgtcgacgacgatcaggctttgggcgagatgctatccatcgtattggagagcgaaggatttaaaaccgtgacctgcttggatgggtggcgtgcggtggaaatgttcccgacattgcagccggatttgatgttgcttgatgtgatgctccccggtttggatggcgtccaggtggcgcaacgcatacggcagaactcgaatacgccgatcatcatgcttaccgccaaatccgacaccaccgatgtggtgaaaggcctggaagcgggggcggatgattatgtgtccaaaccgttcgaggtggtggagcttatggccagaatcagggctcggctgcgcatgcccaaggtaaacgcgcctgcaggcaaggatgagggcgacctgactgaacgattgcaatgcggcacgctcgtaatggatagggctgagcataccgccaccaaagatggtgtggatctgcagctgacgccgacggagtttgaattgctgtacgtgctggcggctcacgcgggtgaagccctgagccgtgcgaacttgctgaaacgtgtttggggatacgtaagtggcggagataccagattggtcaacgtgcatgtgcaacggctgcgcatgaaggtggagaccgatccggagaatccgcggatcgtgcagaccgtgcgcgggatcggatacaagttcgtagccccgacggtataagcgaaccatgctgatgagaacccatcgagtgtggtgtatctggcatcgtgacagacagcaggtgcgccgatcattgcaggcgagaacggtggccgtgtcgatgctggtggtgttgctgacggccgcgttgctgtctttgttttccatgtacgtcatcaggggatccgtgctgaagtaggcgacggatgactcgcgcagcgatttctcatcgcagattgtgcgcgtccagaagcatctgaatgcctcgaatctaactggaacggaccaataccagcagttagtgagcaatctggcgtccgaattgcaaagcaatggttcgagcaatctggtcggcgtgtacctgatggaacgtgatgcagcggattctgcggagcgtggattcgtgccggtatcgacggagccggaatattcaaatctggtgtcgtcatctatgcgcaaccgcatgcgtgccgatacgtccggattgatctactatcagccggtacgtattccgagaacttccggaggtacgcccggcgcggttttgggatcggtgatttcgtcgaataacatgggctcattggaagtgttcgcactgtactcctaccaatcgcagcagcaggcgctgagtcagatccagatcaacatgctgatggtgtgcgtggcgttgagcgtgttgatcgggatgatcatttttctggtcatgcgttcggttatcactccggtacggcgggtcgccttggctacggaaatcatggcatcgggaactttcgacgcccgcgtggcggtggacagggccgatgagataggcgtgctgcagaaatcgttcaatgaaatggccgaatcgttggagaatcagatcgaagagctggaaaaagccggggatatgcaacgcagcttcgtttcggacgtcagccatgaattgagaacaccggtgacgaccatgcgtatggccgccgacatgctgtcgatgcacaaagacgaatacgatgccaccacaaagagaacggtggaattgctggatggccagatccgcagatttcaggaaatgctcgccgatttgttggagatttcgcgtttcgacgccgggtatgcggcgcttgatttggtggaggccgatatacgcgagcccatcgaacagtcggttgaagcgatttccgccatcgcccagaccaaacatgtgccactggatgtgcatatgcccaacgtggaagtgcttgtgagaatcgatacgcgtcgtataagccgtgtcgtacgcaatcttctcgctaatgccatcgatttcgcggagggcaagccggttgaggtccgtcttgccgccaatcagcgaatggtagtaatcagcgtgcgcgattacggcgttggcatgacctcggaacagtgttccagaatgttcgaccggttctggagggcggatccttccagagcgcgcactaccggaggaaccggtttgggcatgtccatcgtactggctgacacgaaactgcatcatggtgatgttgcggtgcgatcgcggctgggtgaaggaacatggtttttggtgacgttgcctcgcaatccggacgatgtcgattgcggtatgaacaacgctccgattcgattcgcgaccgatggcgacgatatgcgggtggtcggaggctttggcgttgccgataacggattcgtggactatctgaccaataaacccatggtggaggggctgtgatgactgcgaaaaacattcgtcgtgtgattgccgcggtctcattagtggtattgctgggatgctccatgatgcatctggccggatgctcgagcatattgggacttcctgaagatggtccggtgcagaccatgaccccggaggaacaaagcacaagaagagtgttcacgtctcccgacgggccggccgatgacgcgcagccggaagccatcgtcaaaggatttttcgacgtcatgcctgcgggagtgcagagtgacgggttcgccacgggcaagcagttccttaccgatggcgccgcatcaaggtggaatgccgataaccggactacggtatatgccgacgtgccgaaattcgtgcgtaaggccagcacggtggagtcagggcaaggcgggcagaaaaccgtggtgagcgtcagcctccagatacaaggggaactggatgcgcatggcgtgtatacggcggtggcgagcggaggggcaaaaacctacgatttctccctctccaaagtgcgtggccaatggcggatcagcaaactgccgacaggcgtgatgatcagctcctacgatttcgagcaggtgtaccgtcaggtttcgctatatcagttgggctcttccgaaaaagaactgatccccgatgttcgttggctttgctggagggattggcggacgcgcgccgtgcaggaactgcttgccggaaatgcggcatggctggaaggcgcggtaagcgacaccaataccaagcggatcgtgttgcagcccgacggtgtgcagatgcgcgattcggtgatggaaatgagtctctcatcggcgatggaacgaatgacggatgccgaacgtggcattttggtcaggcagattcgcctatcgttgggggacggcagcgccgagacggaaatcaaggtgatgtctggaaaccatgactattcgcatgccgatgattcgtcgtctcttgatgcgcagactccgctgaatcccatgtatacgttgagcgtcggcaatatcgtgtcgttgaaatcctacagtgccattcgtgtggcgcaaacggatcttttggacgtgcgaagcttcgttttctcagcacagggcggagccgtgcttggtcgtgacggatatgtgaaaaggctcgcagaggacggttccacccatgcattgatgttttcaggacgcatgatgaaaaccatctgcaaaggaaacgactccgagatttggggcatcgacacatctggcaagcacatcatggtcgatgatgccggcacggttctcacccttgacgttcccggcctcgtatcagcacaaacgctccattccatgaggctttcccctgagggggaccgtatcgcattctccatcgaatcggatgggggagcgcagtcgggtgtggccatcatcgggatatgccgggaccatgatggctccgtggctgggctgtcccaagcgttcgctttggtttccacacagtccaatgtgtcgatgatgacgttctataacgacgtcacttttctctatgccacgcaatacgagcgggggcgtgcgcagatcggacgacgtcagatggtgcctggtcctgaaacgagtcaggcgctacccgacaatggtgcggtcgatatggccacaggagaagtcggcacatatcgcaggcttgtcgtactcgaccatctcggagtggcgagaacggtcgacggatcgttggatggtgcatggacgattgctgattcccaagttacgtcgttatctgtgcaatagtgaaaaagttgtaattccgccattgttatcgtttcgttattgacttgttatcgaaacgttattgctatggattgagaccttggattgttcgaacgatactgaaaacactgatggcaaggaagcccatcaatagaaatactcgaggaggagttttcatgaagaattggaagaaagctattgcgatttgtgcttcggcggcagctatggccagcatggcggcctgcggtggcggcagctccgatggcgattccagctccagcaagagcgataagaagaccatcggtttcgtggcagtcggtccggaaggcggcttccgtacggccaacgagaacgatctgaagaaggcattcgaggatgccggattcgatctggtgtactccccgacgcagaacaacgatcagcagaagcagattcaggcattcaacaagttcgtcaacgacgaagtcgacgcgatcgtgctatccgcaaccaacgattccggttgggatgactgcttggagaacgcggcggaagctgaaatcccggtcttcaccgtcgaccgcaacatcgatatcaagagcgatgcggcaaagaaggcagtcgtctcgcacatcggcccgtccaatgtctgggccggcgagcaggccgctgaattcgtcaacaagagcttcccagatggcgccaacggcttcattctggaaggaccggcaggcctgtccgtggtgaccgatcgtggcaccggttgggataacaaggcagcaagcaatatcaaggtgcttgagtcccagtccgccaactggtccaccgatgaggcaaagaccgtgacagcaggtctgctcgacaagtacaagtccgacaatccgcagttcatcttcgcccagaacgatgagatgggtctcggcgcggcacaggccgttgatgccgctggtctgaagggcaaggtcaagatcatcaccatcgatggcaccaaggccgctctgcagtctctggtcgacggcgatctttcctacgtcatcgagtacaacccgatcttcggtaaggaaaccgccaacgccgtcaaggattatctggatggcaagtctgttgaatccgatatcgagatcgaatccaagaccttcgatgcagatagcgccaaggaagccttggatgccggtacccgtgcgtactgatccgatcagataactttccgaatagcatctctccttttcacatagcccaagaacggtgcaccgcatagcgcgatgcaccgttcgttccatcttgggcaaatatcacaaaacgataacaattttcgtaaggcgaagacatggtagataagcaaccaatcgtcgtgatgaaaggtatcacgatcgagttcccgggcgtcaaggccctggacggcgtcgacctgcgtctgtatccaggtgaagtccacgctctcatgggcgagaacggcgctggaaaatcgacgatgatcaaagcgcttaccggcgtgtacaggatcaacgcgggttccattgaagtggaaggcaagccgcaaaccttcaccggtaccggtgatgcgcagaacgcgggcatcgccaccgtgtatcaggaagttaacctgtgcaccaatctcagcatcggcgaaaacgtcatgcttggtcatgaggtgcgagggacgctgggcatcaactggaagaaaacctatgaggaatcgaagaaattcctcgcccagatgggtctggatcatcttgatccgagagcaccgttgagctccatttccatcgccatgcagcagctggtcgccatcgcccgagccatggtgatcgatgccaaggtgctgattcttgacgaaccgacgtcatcgcttgacgccaacgaagtgcaggatctgttcaagatcatgcgcaagattcgtgattcgggtgtggcgatcctgttcgtgtcccacttccttgaccagatttacgagatcaccgatcgcctgaccgtgctccgcaacggtaagttcatcaaagaagtcatgaccaaggacactccgcgtgacgagctcatcggcatgatgatcggcaagagcgcggacgagctgagccagatcggcgccaagaaggcgcatcgtgacgtgactgaaggtgaacagcccatcgtctccgtcaagcagcttggtctgaaaggcaccatcaatcctacggacctagatatctacccaggccaggttgtcggcttcgcaggcctgttgggatccggacgaaccgaactcggccgactgctgtacggtgcggacaagccggattccggtacgtacgagctcaaaggcaagaagaccagtatctccgatccgtacacggcattgcgcaacaagatcgcatactccacggagaaccgtcgagacgaaggcattattggcgatctgacggtccgcgagaacattctgatcgccttgcaggcgacgagaggcatgttcaagccgattccgaagaaggaagccgacgagatcgtcgacaagtacatgaaggagctgaacgttcgtccgaacgatccgaacaagctcatcaagaacctgtccggcggcaaccagcagaaggtgctgatcgcacgttggctggccacgcatcccgacctgctcattctggacgagccgacgcgaggcatcgatatcggcgccaaggcggaaatccagcaggtggtgcttgatcttgccgctcagggcatgggtgtggtgttcatctcgtccgaaatggaagaggtggtcaggctttctgacgacatcgaagtgctgaaggatcgccacaagatcgccgaactcgtcaatgacaacacggtttcccaggaaaccatcgtccaaaccatcgcgaacacgaacgtcaatacaggaaaggaggcatgatgagcgacaagaaaacaaagcaggacggcgattccctcgtcaagaagctgctgtcgtcaaacctcacatggtctgtggtcgcactgattgtgctgatcgtcatctgcaccatctccgatcaccaattcctctcgttgagctggaataagaacaccggaggtctttcgggaccgctgatcaccatgctgcaggaatcggcgcgttatctcatgatcgccaccggcatgacattggtgatctccactgcaggcatcgacctttccgtaggttccgttatggcggttgccggtgcggcggccatgcagatgctgacttccggcgttaacgtgtggctggcgattttcctcgcactgctcatcggcctcggtgtcggctgcatcaacggcgcattggtttccattctgggactgcagccgttcatcaccacgctgatcatgatgctcgcaggtcgaggattggccaaggtcatcacttccggccagaacactgatgccagctccgttgcaggcggcgcgccgctgaaatggatggccaacggcttcattctgggcattcctgccaatttcgtcatcgcattggtcattgtcgcgctgattggcctgctgtgccgcaaaacggccatgggcatgatggtcgaatccgtcggcatcaatccggaagcctcccgcatgaccggcatcaagccgaagaagatcctcttcctcgtatacgcgatttccggtcttctggcagccgtggcaggcctgttcgccaccgcatccgtgatgcgcgtcgacgtggtcaagaccgggcaggatcttgaaatgtatgccatcctcgcagtcgttatcggcggaacctcgctgcttggcggcaagttctccctggctggcagcgcgcttggcgcggtgatcatcgccatgatccgcaagaccatcatcaccctcggtatcgattccgccgcaacaccggcattcttcgccgtcgtggtgatcgtgatctgcgtgatgcaggctccgaagattcataaccttggcgcggaaataaaacgtaagtgcgcgctgaagacgcaaactaaggcggtggcagcatgacttctgcaacagctactcaggtcaagaagaccgtgaaaccgactcggcgtcgtcttgacgctcagatgattccaaccatcgcagcagtggtgatcttcattctgatgatcatcatgggtcaggcgctgttcggcacctacctgcgtcttggattcgtgtcgtccctgttcatcgaccatgcctacctgattattctggccgtggctatgacgcttccggtattgactggcggcatcgatctgtcggttggcgccatcgtcgccatcaccgcggtcgtcggtgtgaaactcaccaacgcaggcgtcgcggctccgctcgccatggtcgtcatgattctcatcggcgtggcgttcggcctattgaccggcaccctgatcgaagaattcaacatgcagccgttcatcgcgtcgctggcttcgatgttcctggcgcgaggcatcgcatccatcatttcgaccaaggcgcagaccttccccgaaaataacaacttcgatttcatttcgcagaagatcaccatcatcgacaatccgaagatctcccaagatctgtacatcaatgtcggtgtgatcgtcgcggcgctcgtggttatcttcgggtacatcctgctgcaccatacacgcaccggacgcaccatctacgccatcggcggctcgcgctcctccgcggaactcatgggcttgccggtcaagcgcacgcagtacgtcatctacctgacctccgccacactggcctccatcgcctccatcgtgtacacggccaacatccgctcttccatcaacacggtcggcgtcggctgggaacttgatgctgtggcctccgtggtcatcggcggcaccatcgtcaccggcggcttcggctacgtgctcggttccgtcatcggcgctctggtccgttccaccatcgacccgctgacctccgacttcggcgtgccggccgaatggaccaccatcgtggtcggcctgatgatcctgatcttcgtggtgctgcagcgtgcggtcaccgccttcaacaagaaagaataggaggaacggctccagttcataccatttgtttctgattccctttgcgtaaggctggacgtgccgaaatggtacgtccagccttacgcatgccgttcccatctaggtcagggcttccattacactacacagtggtttttcatacgaatgaatcatagacggcatcgcacagggccgtaggaaaaagtgcgcggataaggaattatggaagaacggaacattactacaacaactgcagccactgaatcgcaggcgattacgacaaacgccggaactcaggaagcggcgatttcagacgaacgcatccccggcaaactcatcggagcgattgtggcggtcggctccctcgccttcatcggcattctcaccgaaaccgtgatgacggtgcttttcccgcaactcatgcgggaattcaacgtcgacaccgcaaccgtgcagtggatcaccaccatctacctgctggtggtcgcggccaccatgccgttgtcgtcgtaccttaaccgtcgtttcaagcaccgcacgttgttccttgccgcggtggcgcttgccgtgctcggctcgttgatcatgatcgtcggtcatgcgttcccggtcattctcattgcccgtgtgattcaaggcatgggttccggtgtggccacgccgttgatgatcaacatcattcttgaacagtcgccaaagagcaaagtcggtcgtttgatgggcgtcggttcgctggtcatcaccgtcgctccggcaattggtccgaccgttggtggcgcggtgtcgagcattctgccatggcgtgcgattttcgtgattgtcattccgatcattctgctggtctcgttgccggtcggtttaaaatgcgtcgaacagcatcgcccgacggaagaggcgcgtctcaattcgttgcagttcgtgtcgattgtgcttgcattgtgcggattggtgatgttcctgaaccaagctggagtggccgtcagcgccgcggtttccggcggcagcgccacggtgtcggcagtgttcgccgtggtgagtctgatcgttggattgggggcattgctgtttttcggctggtcgtcgaagcgttcgttctcgccgctgatccgtttgggctggctgcgtgacccgatggtgttgttacatttgatcgcctacatgctgctgccgatcgtcggcatcggtttcggttatgtgatcaccaatgtggcgcagctttcgttgggaaccagcgcgttcctgtccggcgcgttggtgctgccgggtgcgctgatcggcgcgtttttcgcaccggtgggaggtatgctgtacgaccgtttcggaccggtgcgtccgattctcggcgcgtttttcgccgcgatttgtgggccgattctgctgctggtattttccatgcgactgacacccgtcacgcttgccggtttctacttcattttcggatttggttattcgcttggtttttccaatatcatgaccaatgcgttgcgtaacatcgcacctcagttcatgccggacggcaatgccgtgttcaacacctgcctgcagttcggcggcgcggcaggcaccgcgctgttctccacgattctgtcggtggctcaggctggcgcaggcgaagaggggagcaccacgttccgtcacgctacggctgtcggtggcagctggacgttcgctaccatgattggtatcgtggccattgccatctgttgcttgattgcggcgttccgtattggtgcgaaacgtaatagcaggctatagaaaaagcctgtagcgtaaagtgaggaaagcgttccgtcaaggaatatcggcttgctatgctgtctctaccgtgttattgagaggacagcaatgagactacagcacccgtatagcggcatcactaccggtctgctcaagccgattacggcggcgctttccatagttgcgctgcttgcgggctgtggatccgtggaggcgaaggattctcagcaggaagtcaccagtgccgataaggtggtcagcgtcaatatcacggaaccatcgaatggcttgctgccaagtgacaccagcgatatggccggttggaaaatcgtcagccagctgtatgacggcctggtcactttcgatgcggaaggtaatgagacgttggtcgaggccgaatcgatcacgccgaatgacgacgcttccgaatacaccatcgcacttaaaccgaatctggcgttctccaatggtgagaagatcaccgccgacacgtacgcgaaaagctggtcattcgcggccaatgctgccaatggacaggtcggagcctccattttcgaagatattcagggctatgatgagctgcaggatgcaagtggttccaaaaccgcgcaattgtcaggccttaccgtggtcgacgacactacgctgaaggtcaagctcaaagcgtcgaattcggcgttcctgtacaaaatcggagatatcgcgtttctgccgatgccatccgaagtcatcaagaatcccaaggaatacgggcaaaagccgattggcaacggtccgtacaagctgaaggcgtacaaaagcggcgaagaaatcattcttgaaaaagacgactcctacaaggggccgcgcgaagtcaagaacgcaggcatcgatttcaaggtgtatcaaagtcttgacgcagcctattcggatctgctggcagacaacctcgacgtgcttgatgccattccgacttccgcgttgaaaacctatcagaacgaaaagaacatcaccgccgtcagcaagcccggtccgtcgttctcagcatttacgatttcgcagaatctcaagcatttccaaggtgaggaaggcaagtatcggcgtcaagccatcgcgcatgccattgaccgtgagaatatcgccaatgcgattttcggtggcacggtaacgcccgccaccgatttccttgcgccggtgatcaagggatatgacaccgatctcgacacggatggcgtgctcgcatatgatgagacgaaagccaaggaattgtgggcgaaggcggatgcgatttcgccatggagcggaacgttccgcatcgcatacagcgccgatggcaccgataaggagtgggtggaggctgcggccaattccattcgcaacgcgcttggcatcgatgcggaaagctatccgttcgccacgtccaaggaactgcgcagcgccattcaggagcgcaccatcgacgcggcattcaaatcgggcatgcaatccgattatccgcatccggaaggctatctggtgcaggtatacgactcatcggcagcggacggcaagggtttgaacaacggtgattacaagagcgacgaatttgatgcgctgattgaccaggctgctgcggagaccgatttggacaaggccgtgagcctgtatcggcagagcgaacgtgtgttgctgaaggatttgccggtgattcctttgtggtataccaacgtgaccgcggcatcggccaaaaacgtggaagtgagctacaactatatgggcgttcccgaatacaacaccatcgtcaagtaaggtttgttctagcgtgaagactccactgtgagcgcaatttcaccacccgtcgcttcgaagcggtaggctgtgaaactatagagaacataggaaaaggagacaaggtgagcaacctcagtgcacccctgcccgtcatggccggcgaagatatgccggccggacccgccgatccgattttcaaccgtctgctgaaagaccgcatcatttggatgggcgaggaagtcaaggacgaaatggccaatcgcatctgcgcacagatgctgatgctggcagctgaagatccgaagaaggatatttggctgtacatcaattccccgggtggttccatcaccgcaggcatggccatttacgacaccatgcagcttatcgagcctgacgtggcgaccgtcggcttgggcatgtgcgcatccatgggccagttcctgctgagctccggcaccaagggcaagcgattcctgacctcgcatgcccgtgtgctgatgcaccagccgtccggcggcatcggcggcaccgccaccgacgtgcgcatcaacgctgaactgatcatggacatgaagaagaccatgagcgagctgactgccgaacagaccggccataccgttgaggaaatctaccgcgacaacgagtacgaccactggttcaccgcgcaggaagcgctggaatacggttttgtggataagctcgtttccacgcacgacacgatgaacgccaccaagggagagtgaacatggcaagcgaagaatcccgattcgtagcccgcgcagagcgtctcgcaggaccgaccggagtggttggtttccaggctgcagcagcccgcgaagccgctttcgcgccgcagaaccgttatgttctgccgcagttcgaagagaagaccccgtacggtttcaaaaggcaggatccgtacacccgcttgttcgaagaccgcatcatcttcatgggcgtgcaggtcgacgacacttccgccgacgacattatggctcagctcctggtgctcgaaagccaggatccgaaccgtgatgtgatgatgtacatcaactctccgggcggttccatgacggctatgaccgccatctacgacaccatgcagtacatcaagccggatgtgcagaccgtatgccttggacaggccgcttccgcagccgccattctgctggccgccggagccaagggcaagcgtctgatgctgccgaacgcgcgcgtgctcatccatcagccggccatcgatcagggcttcggcaaggcgacggaaatcgaaatccaagccaaggaaatgctgcgtatgcgtgaatggcttgagaacacgctggccaagcataccggtcgcgatgtggagaagattcgcaaagacatcgaggtcgacaccttcctgaccgcacctgaggccaaggaatacggcattgtcgacgaagtgctggaacaccgtagctgaacggcgcatatgcgaggttccatctgaagtcgcatcttcacaaatcaatacccctgccgggcgttggcaggggtatgctgttcttcaatgatgattgcatgatggcgattgctcaatggcaggtacggcaaacaaaggggtgcgaatgggacgagtggtcagctacaacgatgaagtgtcacgatgcacgttctgcggcaaaaccgaaaatcaggtacgtaagctcgttaccggatcaggtgcggccatttgcgacgaatgcatcgaactgtgcgtcgacatcatttccgaagaacgtgtcaaagacgcccagctgaacacattgcagctgccgaaacccgcacagatcagcgcctatctcgacaactacgtggtcgggcaggaatccgctaaaagaacgctttccgtggccgtatacaaccattacaagcgcgtcaatatggaaatgcgtgaatccgcggcattgcgcgatcgtgcggcgcatgcgagcgacgatccactggccggcgtgcaggtgtccaaatcgaatatcctgctgctggggccgaccggcgtgggcaaaacgtatcttgcgcagacactggcgaaggtcatgaatgtgccgttcgtcatcgccgacgccaccacactcactgaagcggggtatgtgggcgacgatgtggaaaccgtactgcaacggcttatacaggccgctgacggcgatgtggcgcgagcgcagcagggcatcgtctatattgacgaaatcgacaagatagcgcgtaagagcggcgagaatacgtctattacgcgagatgtgtccggtgagggcgtgcagcaggctctgctgaagattttggaaggtactgtggcatccgtgccggtggagggttcgcgtaagcatcgtgagatggagacggtgcagatcgacactcgtgacattctgtttatctgcggcggcgcgtttgtcgggcttgccgatattgtggcgcagcgtttgggcgctcgtgaaagcggatttggtgccgcgtggcatgatcatgaggtgccgaatcgtgagctgcttgcccaggcttcggccgacgatcttgccgatttcggtttattgcctgaattcatcggtagattgccggtggtgagcgtgcttgaggagcttacggaggatgatttggcgcgcattctggtcgcaccggagaacgcactggtcaagcagtatcagaagttgtttgcgattgacggggtgacgttgacgttcactgagggggcggtgcggcagatcgcggccacttcgattcgcaggggcacgggcgcccgaggccttcgatcgattatcgaaaaaaccttggaggacacgatgttccagctaccaagcgtgactggcgtatcggaggtggtggtggatgaggcgtccgtcaatggttccggcactccgaaactattgaaggtttccacggaggagattcctcgcagacgtgccgcgtagtgcattcggcgtgttgcgcgtcgtatgtgcgagagttcagatttcgtagggttgaagcaagtatggatgccggtgcgaaatccacgaaaacaggcgcgacacgccgagattttgctgcgcggccatttgggtgtatcttattcgagttgccgaaaacaagcaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcgcgagtagcccagcggattagagcagctgactacggatcagcaggtcgcaggttcgaatcctgtctcgcgcaccggccacccgtcatcaggcggcataaataaatgagatgacgttgcgcgagtagcccagcggattagagcagctgactacggatcagcaggtcgcaggttcgaatcctgtctcgcgcacatgaacctccttcgcgaaatgcggaggaggctttcttttttctggaagtaacggcggcgctgccgtgaatagtgttcgaatcaatgcgattcgcaaacctaccagaatgcttatgtaaagcggctgttgtcgagatacgttcggtttctctccgagcgaacggtgtggtacaagaaaagccgccatgccgaataaaaccgtaaacaccagtgaaaaagacggtttggaaacataaacgccgacacctctcggtacactggaaccgctattgaagcgtctgcgcatgccaataccgcagacgcttttcttaagtgaatggcgggccgtggatactcgcggcaacagacgggagagcaatgaccgaacgtaagcagggactctgggcgaaaatacgatacatagccgcttccgaccgcatatctggtctgattatgcttggcttcgccctcgcaggtctgttgcttgccaatctgccgttcacggcgcattcgttcgaagagttggagaatttccgcatcgccattccctacaccaatatcgatatgggattgggacactgggtgcaggatggtctgctgacggtgttcttcctgactgtcggactggaattgaaacaggaactcgccacaggttcgctgtcgaaccccaaggctgctgcagtgccgatgctgtgcgctgtgggcggtatgatggctcctccggtgttgttcctgctggtattgttcctgttctccggtttcggatccgatccgttggccatcgcttcgggaacgagtttcacctttggtgagatgtctcatggttgggcggttcctacggccactgatatcgcgttctctttggctgtgcttgctttgttcgccaaagcgctgccgggctctattcgcgcgttcctgatgacgcttgccacagtggacgatctgctggccattattctgatcgcggtgttcttctcttcggtgaacgcatggtactggttcgtcggcatcgccgtatgcgctgtcgtatggtatttcctggtgcgtatgcgcaaagtgccatggcttgccgtggccattgtcggcattctggcttgggtgatgatgttcgaagctggtgtgcatcctactttggctggcgtgcttgttggattgctcacgccggctcatgagcgtttcggagagaaaaccccacgcgccgaacgctatgcggacaagctgcagccgttttccgcgttgctggctctgccgattttcgccttgttcgccactggtgtgcattttgaatcgttgacgttggccctgttcatttcgccggtcgtcgttgccgttatggtggctctggtggtcggcaagccgttgggcattatgatcacggcatggctttccacgcatgtggccggattgaaaatggctaagggattgcgtgtgcgcgacatgttccccgcggcctgcgcatgtggcatcggctttaccgtatctttcctgatttcctcgcttgcatatcaggatgccgaactgtctgctgaagcacgtttcggtgtgttggtcggttccatagtcgcggcggtgatttccggcattctgctgagccgccaatccaagaagtttgagcttgccgctgccgcatcctcgaagcataagcatcatactgctgacgaggatgctgctggggaagtggaatctgttctcgaagacggcaccgttgtggtcagccagatgatcgacacacatccaaaggtcaaataacgacgttccggcgtatggcattccgcgccatacgccagacacaacaaaagccgacactcatcacttatccgtgagtgtcggctttttgtatgaggaaacggtaggccgctgggaacggccatactagcgtttgactgctacgagcaggcccgtaccggtcggggtgagggcagtgacgaaacgctcatcggattccacggtttccagcaaaccacacatggcaatggatttggcgtcacgattggcgggattcaaaacgccgcctgcggacgtggctgaatcaaaagcaagaatatcggtgaacacgattacgccatgcttcttcaacaggcggggagcctgctcgaaggaagcgccgtaattttccgcgtcgccggcaactacaatcaaatcgtagttttctgcattcagacgtggcaaaaacacgtcgacgggagcgttgacggcgcgaagcgtggtctgtgtctcgtcggaaagccgattaaacaacgtacgaatcagcgcaatgccctgggaagaggaatcaaccgccgtaagctgaccggaattatccaaaccgttgaccagctgcaacgtttccaccacggaaccggtgccgacggcgatcaccgatgtcgcattcaccatatgcacgagcatgcgcaacagctcggcttgggctgctgaaccctgcggaatgcctgcttcttcagcatgggtgcgaatagcattcaagtcggttgactggcgggagaacgcatggtcctcaacgtattcccatgacttggcgagattggtatatgacgttctatccatgggttcagcgttccttgacttgggcgatcagctgccagatttcctcgccgacgtcaatgccacgcgggcattcgcgggtacatgcgcggaccgactggcatgcggcgatgccatcggcggaatcaatggcatccatgcgtgcgttcgcctgaccgtcgcgggaatcgttgatgaaacgagacgccgcgataagggctgcaggtccgatgaacgcttcgccgcccgcatacacagggcagctgccttcgcaagtgccacaggcgatgcagttgctgagaagctcatacttggcaagctgctggggattctgcagatattcgaaagcgttgatcttgccgtccgcagtggtggcgagttctccatgcgcctgcagatagggcttgagttttctgatttggttgagcatctgatcgatatcggcaatcaaatcgcgctgcaccgggaaacccggcaggggagcgagctcgatgacgccaagatcccctgcgccgaccgcattttcctgaatgtcggaaacatctccggtgtgtcggaatccttcatcgtcgaccaatgtcggattcgacggtttggcccaatccttgacggacgcggtgcacagcagggtgggggtgccgttgatggacaccgcatcggaaccgcacatgccatgtccgcacgaatagcggaatgccagcgtcggatcgatggtgcgtttgatcttcaacaggcaatcaagcaccgtgtcttccggacgcacgttcaacgtgtaatcctgcaaccactgcttgccgcgcgggcggcggcgcgccgacgtgccggaatccccaaacggagagctttttctggcgaacggagagccgccacgttcgcggtcgcgggcacgctcggcgcgcggggcaaacctattcacccgcaatgtcaccgtattcacgccgttttccataccgctcatgtacccgcctttccaataaaaccgtcaactagtctgccatacgccgtgcccagcggaatcagtattcgcgggcttttggcggcatattcacaatgtgcaccggctgccaggaaatctggccggaggcattcaccatggaatgggccaggaaatgctcatcgtcgcgttccggaaaatcaagacgcttcagcgagccacgggattcgtgacgcgcatcggatgaggtgagtacggccttgccgagttccagaaggtggcggacctcccaaatggcggtgatctcctggttgaacgtgggggagtcggaatgcgcgtgcagggcttcggcacggggcgcaaactcatcatgcaatgccgttagcgcctgttcgataccctgctcgtcgcaacgcacggcgacagcgcgttccatgacggtacccagatcggccatcagctggtaaggattgtcggctgcatgctcctcgtcttccggaagctgcaccagcagatccttgagttcgttggaacgggtgtcagcggcctgctggaccgcatccgaaccattgtcggcgtcggattcagccatgggatcgttcactggagcgctggaaatgcgttccgccagcgccttgccggagcgggtgccgaacaggcatgcatccagcagggaattgccgccgagacggtttgcgccgtgcacggacacgcatgcgcattcgccggcagcgaacaggccttcgacgacatttcgttcgtcgttctgccaacggtagacttcgccgtcggtggtgatcggaatgccacccatggtgtaatgcgcggtaggcttaaccggcacgaaatcgtgtgtcggatcaagatccgcatatttttcgatggtttccaccacctgcggcagtacctcatgcatatggtcggcatcaataccggtcatatcaagccacacgcaatcctttggcccttcggggtccttcggatccgccacgccgtggccggcatcgatttcagccataatggaacggctcaccacatctcgtgcagccaaatcggcatggccgggagcatacttttccatgaatgcctcgccatcggcattgcgaagcacgccgccttccgctcgtgccgcttcagacagcagaatgccggtatgcgccagaccagtcgggtggaattgcacgaattcgctgtcttcaagctgtagtcccgcttgcagtgcgagagccatgccgtcgccggtcagatcccatgaattggaggtggtgtggaataggcggcctgcgcctccggtggccagaagcacgttgcgtgcgtggatggcgtgcgtttggcccttatgcgtgtcaaatgccactacgccttcgactttggatccgtcttcggtgattaccagatcggtcacgtaccattcctcggcgaattccacgccttcggccacgcattgctgccacaaggagaagaggatctgatggccgatgcggtcggccgcataggcggcgcggcgaaccggttccttgccgaaatccttggtatgtccgccaaaacgtcgttgtgcgatatggccgtcctcagtacgggagaacgccacaccgtcatgttccagatcgattacggtttccgacgcctctttggcgagcagctcggccgcgtcctggtcgacgagccaatcgccgcctttgaccgtgtcgaagtagtgccagtgccagtcgtctttttcgacgttgccgaggctggccgcaatgccgccttccgcggaaccggtgtgcgagcgcaacggctggagtttggagatcaccaggatgttcggctcgatgccggcttccttcagggcttgcatttgttcgcttcgcagcattcccaatgctgcggacaggcctgccgcgcctgcgccgacgattactgcatcatacatatcttcaacatgcttcggactcatagcaacgattttcgcacaaggtgtgacctcattgcggtttgccggttggcgggtttgccgctgcatgcgtgattatgcgtgtctgatgcgtatgttttcgatggattccgttgatctgtgcaggcttggcggtggcgttgttgggcgtgatgtcatgtggcgcttgcgtcggtgatggtgatgttgccatgctgtgtgcagataagtccgttgagttccattaatcccagctccatgctgattcgtgagattgagtattctccgggattgctttcggccaggatggcgagtagaccgtcagtggagacgtggccgtatttcgcgctgcatgttcgtatggctttgagtatggctgcagtggcgttggttggttgcgacagactggtgtcggttgactcttccgacggttcgtcgtcgttgtctgccgcgtcggctgattgcgggcgatgcgctgcgtggcagaattcgtcgatatcggtcagcgagcagatgatggaggcttggccttcttgtatgagtcggttgcatcctgtgttgtgaggcatggttacatctcctggcacggcgaatacacggcggttgagttcgttggcccatcctgcggtgttaagcgcgccggagcgtgcgcgtgcctgggctacgatgagggtggatgatagcgccgctatcaggcggttcctgataaggaatcgtctggcttccggaacggttccggggcagagttccgagatgagcgcgccggaatggttgatgatggtttcgaagaggcgctcgttgcttttcggaccgatatagttgagtcctccggcgaataccgcgacggtgcgtcctgcgaggggcgttccgatctcgtccatggcttggatggctccccagtgggcggccgcatcggtgcccagagcgcctcctgacactatgagatggcctgctcgggccgcttgtttggcgagctcgtgtgcgctttgccttccgtactcgcttacgccgcgtgatccgacgacaccgaccggttcggagcatgacaccaacgcttgggggtcacctttcccccataggcataatggcgcggcccagtccgtgtgtatggtgaggtcggcaagctgcgaaggccagtaggggtgatgcggtgcgacgatccactgcgtgccgtttgcggtgaaccacgttttgagctcctcggggtcggtgctgggcaatgtggtcaggcgatgctgccacgagaccattgcgccgtggaaggaggccatacctcgagcattgatggtgcgtccccaacgtgtaatgccgttgatgagcgccgcgtccaaggttttataggctgccgtggccacgctttcatgattgcccggaccgctgtcggcaagcagttgcaaggtatgcgtggctgatccgatgcctttgaccagcgcgtacatcatcgcatcggcgctgtccagacaataggtgagcaccgcgcgtgacagggtctcatcgtcgatggcggttgcgttgacgctcgtatcggcggttgtgttctcgttcatgtcaacctcgttctcatggagattccttgcatcatctcttccggtccgggagaggttttgcctgacaggtcggatagcgtccatgcgagtcgcatggctcggtccgcccctctgaggctgagccgttcgctggccaacgcatggttcacgagctcgatggcttttgtggacgtgttggcgcgaagccatgttccggtggcttgcgcattgcagacccatccgaattcccggaaacgttcctgtgccgtttgccttgccaccatgacccgcaggcggatggcgtggctggattcgccggaaggaaccgtgcctgggttgatgcgttccacaggaggcacttcgatctgaatgtcgatgcggtcgaggatcggccccgacaggcggctgaagtacttgatacggtctttttccctgcacgtgcagcgctcgccgttgccgtatgcgtagccgcaggggcaaggattggccgccatgatcagttggaatcgtgccggatagtaggtggtgcctttcgcgcgggatatcgccacatacccggattccaatggttcgcgcaaggtttgcagggtgcgtgccgagaattcgggcgcctcgtccatgaataggatgccccgatgcgcccgcgtgatcgcgcctggttgagccaatcccgcgccgccgccgaccaaggatgcggtggatgtggtatggtgcggcgcttcgaatggcggaacatcgctgatgccatagctgggcaatgtgccgcatagggagcggatcgaggcgacttccagttgttccgattcgctgagcggactcataatgccgggaatgcgcgaggcgagcatggtttttccggtgccgggaggaccggtcatcatcagatgatggccgccggcagccgccacttccaacgcccatttggccgtttcctgccccatgacttcgttcatatctccgggaggaggacataccgacatggcgccgtcgttggcatccacgtctcggatcatatcgggtatcgtatagttcgcggtgcctcccatcagttcgatcagttcgccgacgtgacgtattccaatggcgtcgacgtcgggcacaagggccgcctcgtccaaattggcatgcggtacgatcaccttgcatacgccttgatcgcgtgcatgcagcagaatcggcagcagaccgttgatgggcagtaccgtgccatcgagattcacctctccgagcacgacggtgtcgttcaagcagtcatgcggtatcgttccggatgcgctaagcacgctcgctgcgatcgccagatcgtgtgaggatccgcgtttgggcatggacgccggcgaaagattgaccgtaacccgtgtttccggccatttggcaccgctggcctgacatgcggatttgacacgttccctcgcttcggagagcgaggtgtcgggaagtccgatgatggaaaagtaggggagtcccggagatacgaacgcctggatttggatgatgaaggctttcaggccgatgagacccacggaaagcgcgctgccgatagccatcagaacgctccttcgatatggtggacaagcggtttgccatcacggacgatgacggtgacgacgtcgaagcgcacgccgttatgcggcgtgcgatggtcgctgtccgacagccattgcacggccgcgtggcgcaggttgatctgcttggatgacgtcacggcttcctgcggagtgccatagcggagcgtccgcctggttttgacttcgacgaagacgatgattcccgtatcgtcgcgtgaaacgatatcgagttcgccatatcggcagtgccagttgcggtcgagcgtctgccagccttggctttccagccatgcggccgcatactgttcgccgagttcgccgacctgtcgtgcgcacagtgtgccatcatgcagtcgccgtgcgatggaatcaagaagctgttccgagcgctgcgttgcgttcggaacgttatgtgttgtgttgccgttcatgattcaagtccagcagaaaggaccggcgcgaagcaagggcgaacggcgaatgtggatagaggatgcggtttcgggcgtgtttgggatagttggtggataacttgccgttatccacattgctccacaaggcgagcggccatggagcgcccgaaaccgcatatggttggaatgttcagcggcgaaccagacgcgtcaactcgtcaaggttcagctcgaagctcacaccgcgctcagtgtggttcggctggaattgcgtgctttccatggcatggcgtacgaattcaccggcgatatgcgccgattcagccagaggtctgccggccatcaccgcaccgcataatgcggatgcgaaggcgtcgccggtgccatgtgtcatgaacggcagcttgtcgtgcgcaagctcttgcttgccggatgcgccggaagtggccgatgccacatagttgcgaatgatgccatcctgacggtcaacgcctttgagcaccacgtttttcgctcccaaggcaagcagcgcgtcaataatgccgttcacttccgcgttgtcgatgttctgccccgggtaggtgcgtcccgtcagcatggacgcttccgtcaaattcggcatcagcacgtcggcgccatccaccagcgtgcccatcgcctcgcataattccggcgtgtatgtggcgtagatctcgccgccgtctcccatcaccggatccaccaaacgcaaggcgtgcgggtaatccgcatacagacgtttgataatcgtgacttgttcggcggaaccgaggaaaccggaatacacgccgtccaaatcgacgttctccttgcgccacgcatccagatagccgtccaaaatttcggtcgtatcgtggaacgtgaacacgctgtagcgcgtatgcgccgaaaacagcgccgtcggcacggggcatacgtcgcatccggccgccgacagaatcggaatggccgccgtcagcgagcacttgccgtaaccgcacatgtcgtgcaccgcggccacacgtggaatgtaccgtgggtcacggtcgaacagaatcacatcattcatgggaaccctctcttgcgattgcctgaccatgactttagccgcttgcctgacttcaccgccccatcgcctcgtacggcgggtcaccatgatgccgtttgctggcgtgtcgcaagttttttgatggctaccagagtagttttgcaaagcctggatggcaatgattgcaacggtttataaggggatataggcaagtgcgataacgctcggtttgcattgcgaagcgacgtcggattattgtcgctaccaacacctgaccaaccgccacacacggcaaggcgggtggtcagcaagacaagcaacgaaccacttccccacaaggagcagaaaccatggcagattccaagaactaccgcttcgaaaccctgcagcttcacgtcggccaggagcaggccgacccggcaaccgattcccgcgcggtgccgatctaccagaccaccagctacgtgttccataactttgatcacgccgaggcgcgttttggtctggccgatccgggcaacatctacggccgcctgaccaattccacccagggcgtgttcgaagaccgcatcgcagcccttgaaggtggcgccgctggtttggcagtcgcttccggcgccgccgcggtcgaatacgccgtgcgcaacatcacccagtccggcgaccacatcgtggctgccaagaacatctacggcggcaccttcaacctgctgcgccacaccctgccgcgtgacggcatcaccaccaccttcgtctccgctgagaacccgcaggagttcgaggatgccatccaggagaacaccaagctcgtctacttcgagaccttcggcaacccgaacgccgacctgccggatttcgaagctatcaccgccatcgcacacaagcatcatctgccggtgatcgtcgacaacactttcgccaccccgtacctgttccgcccgctggagcacggtgctgacgtcgtggtcgaatccgccaccaagttcatcggtggccacggcaccaccctcggcggcgtgatcgtggaaggcggcaacttcaactgggccgaagtgccgggcaagttcccgaccctgaccgagccggatccgtcgtaccacggtctgaacttctacgaggctctgggcggttccgcgttcgtgacccgcatccgcgccatcctgctgcgcgacaccggcgcaaccctgtctccgttctcggccttcctgctgctgcagggcaccgaaaccctgtcgcttcgcgtcgagcgccatgtcgagaacgcgctgaaggtcatcgactacctgaagaccgttccggaagtcgaatccatctcccacccgtccatcgaaggccgcaaggacaacgagctgtacaagaagtacttcccgaacggcggcggctccatcttcaccttcgacatcaagggcggcaaggacgcggcacgcgtgttcatcgacaacctgcacctgttcagcctgttggccaacgtggccgatgccaagagcctcgtgatccacccggcctccaccacgcactctcaggagacgccggaggagcttgaggaccagggcatccaccagggcacgatccgtctgtccatcggcaccgagaacatcgaagacatcctcgacgatctcaagggcggtttcgcggctctgcgcgaatccggtctcgccaagtgaggcgtatcggatcggcggaataacgccatcctgagcaaatgaaacggtttgtggcaccgaagagaaggttggtgccacaaaccgtttcgccatattcgcggacgttgtcatcgtaatgtagcgcagatggtatagaatctgcgattgttacgaaaagtaatatctaaattctatcttttgaaagaaagaagttcagatttctttcaaaaagataaatagtggtaatgatattgcggattacgtaaagagagaagagagaggcgattatggctcaagaagtcaagaacgatatcaaaaaggcgttgcaggtcaacaccattccgctgatcgccattatgaccgcggtcaccacggtgctgaccatgctcgtgaagatcccgaccccgatccgtggctacctcaacctgtccgacaccatgatctatttcagcgcgtatgcgttcggaccatgggtgggcggcattatcggcggtcttggcccggcgttgagcgatctgatttccggttatccgcagtgggccatcttcacgttcgtcatcgatggcctgcaggccgtgctcgtgggcctgctcgtcaagaagttcaatccggcgaacatcatcatcggttcggtgatcgcaggcgtatggaaggtgttcggctatttcatcgcaggcggaatcctttccggatttggcccggcgttgggtgagatcgcgggcaactccttccagatggcggtgggtctgattgtgggcttcgcgctgttcaccgccgttcgtcaggcctatccgccgctggtacgtttgggcaacctcggtattaaggcgggggagtgatacattaatatcatgtgaaggcaggcccgtggatttgccgatgaaaggcgattccacgggttttattgtgaaatgcggttaccggctgcggaaaaaatgcgtgaaagcacggggtgagcgtcatgattacggttcgcgacttaggatggaagtacgcgccactgaccgacgggagcaagccggtggaaagtctcaagcgcgtcagcttcgacatccggtccggatccttcgtcggcatcatcggaccgaccggagcgggcaagtccacgctatgcatggcattggccggcatcattccgaacctggccgacggcaccatgagcggcgtcgtggaagttaacggcatgaatacgagcaggcactccgtctcggcactgtcggagcgcgtcggctacgtgcaacaggatccggaagcgcagctgttctgctcgagtgtcgaggatgagatcgctttcccgctggaaaaccgcggagtagccccaaacatcatcgacaagcagatcgacatcatgctcgacttagtcggcatggccggataccgcaagcgtgtgccgaccagcctgtcgggaggccagatgcagcgcgtggccatcgccgccgcgctcgcggcggaacccgatgtgcttattcttgacgaacccaccgcggccctcgaccccgaaggcaagcaggaagtgttcgacgtgctcgaccgcattcgccagacccgttccatgacggtgatcatggccgagcaggataccgaacacatcgcctactgggccgatcaggtgctcttcatggtcaacggtgaagtggtgcgcaatggagacgccagcctatttacccgggaacgtagactgttggaatcctccggcgtgcgggtgagtgacggaccatctcccgtcatcaaggcgttgccggtaggggacgacgccaagccgaagcatgcgatcatcagtctggaccatgtgacgcaccgctatgggcagggcggcaatgcgtctcccgcactggacgacgtcagcttggatatcgaacagggcgccttcgtagggcttattgggcgcaacgggtcaggcaaaaccacgctcgccaagcatctgaacgggctgattcaacccacgcaaggaatcgtgaatgtggatgggctcgacgtgtcgaagcatagcgtgggcgaaatggccgcgcacgtcggattcgtattccaaaatcccgaccatcagattttctgctccagcaccaaagaggagatcgcgttcggcccgaccgcgctcggacttgacgcggccaccgtgttcaaacgtgtcgacgaaatgatgacattgttcgacctgcaccggtatgaggatgtttcgccggccacgctcggctacggcgaacgacgtgcggtggcattgtcttcggtgatcgccatgcgtacgccaatactcgtcctcgacgaacctacggcgggtctcgaccatcgtctcgcatcacgattccttggaaccgtggaaaaactcaaccggcatggcgtcaccgtcatcatgatcagccatgacatgcgtgccgtatatcggtattgcacgcacgtgctcgaattggaagacggtcatatcgtgcaatatggaccgatcgacaaatcgcaggaagcgcaacaatcgcccgcgcgacaggcgcggcagccgtacaagtcgcgcggtccggtatcggcgacccacgtattgttgaaaatcgccaaggatgaatgcgacaaggaggaacgctgatggatgccgacctgtatgtgccaggcgacggatggttgcatcgcaccgatccgcgcgtcaaattcctcatctccatcgtcatgctggccctttgcctcgtatggcgtaactgggcgttcatcctcggcatcctcattctcgaacatgtgatgctcgccaccgaccgtgtgcccgccgaacgcattggatgggtgtggaagatcctcgccgtgctcatcgtgttcatcgtggtgctttggccggtctttgaccagagtggaacgcacgtgctctggcagtggggatggttgcgtctcacgcaggagaacctgctcatggcggcggtgatgggtctgcgcattccagcgctcggctttgcatgtttcatcacgctgttcaccaccagccagaccaaactggttcgtggccttacctcgcttggtatgccctacaaggccgggcttaccctggcaaccgcattacggtatattcccgtgttcttttccatcttccaatccgtgtccgaagcgcagcgtgcgcgagggcttgatctgagcggcaaagtcaatgcggcaggtaaaaaacgcaacatattcgtacgtctcgtagaccggttcaaatcgtatctgccgatcatcatcgccgtattgatccgcgcctacaaaatgagccaaagcgtgggctgggccatggaatcgcgcggactcaacctgaatcggaacggtgtgaaacgcacatatcgggtcaatctcacgatgagcattgccgactggattattctcgtgattgccatcgccgccgccgcaggcagcgtgtggttgatgacatggctgtcatagggggtgcaatgacacaggatgaagggcgtaccacaatcaccgcacgtgatttgaaggtggtatcggcactgcaatgcaacggacgcatgaccatgcaggcgcttgccgataaaatcggcatttccgtatatgcggcgacggaaagctacaaacggctcaccgatgcgggcatcatgaccattgtgcccgtatgcaatccgttgagtctcggcaattacagtcaggtgcttgtgggactgcgcatcaacggcaatcgcaacgaggcgctcgccatgctcaaagccatgcctcaggtcacctatgtggtctgcacgctgggcgatgccgacatcatcgccgaagccgtggtgtattcagccgacggtatggaccatttcctgaagtacgatttgcgcgcactgcccggattgacccgtctgcaagtgttctcctgcggtcgattggtgcttgacgaccataatgtcagcgtggtcaaccgtctgctggccgaacgcggcgaaactggattcatgaccaaacgtgaggccagcgtcggcaccgatattcccgtgcatcggttggacgcgcgattcgtgcacacgttcaacgaattgcagaaagacggcagggcaagttacgccatgctgggggagcatcttggtgtgacgcacaccgcgattcgtgggcgcgtcaaaaaactggaggattccggtgtgatgcgcattatggccacggtaagccccatgcgtttaggcggattccgccaagcgtttctcggcatcggtgtgaagcctccgtataggctcgacgtcgaacagttgctagcgatcgacgaggtgacatatgcaatgagcggagtcggtttgaatggcgccgactacctcatcgaaatcatcgccggagatgacgaggacctgtggcgtgtggtggatgagtccatccgttcgctgccaggcgtggaccagacatggtgggcttccaccgtcagcgtggaaaaagagtcgtactggctcgaacctccgcaggatggtgtactcctcgacgattgatgaatcaatggtatgagacgtttcatttttgctcattctcaaggatgagatgataattcagaccaacgcatgatattcgaatcagctgtttttccgtaattttggaggtaatccaaagaaaggaatgacagcatggatatcagggacaccatcaaagctaccaatacggccattgcaaccgtggatcttgtgaaggactacggttccggaaataacacggtgcatgcgttgcgcggcgtcaacgtcgcttttgaaaaaggaaaattcacggcgattatgggaccttccggttccggcaaatccacgttgatgcacacgttggcaggactggattgtgcaaccggcgggcacatcatattcaatggcgacgatctgacgcgcatgaacgacaaccagcttacgttgctgcgccgccgcgacatcggattcatcttccaaagcttcaacctgctgccgatgttcaccgccgaacagaacattctcatgccattgaccttggctggagcgaaacccgaccgacagtggttgcgtctgctggtggaaacgcttggccttaaggaacgtctcaaccatcgtccgaacgaactatcgggaggccagcagcagcgtgtggccatcgcacgagcattgatcaccaaaccgaaactggtgttcgcagacgagcccaccggcaatcttgactccgtatcaagcgccgaagtgctaagcttcctgaaacgttccgtcaacgaacttggccaaaccatcatcatggtcacgcatgatgcggtcgccgcgtcttacgccgaccgtgcgctcgtgttcgccgacggccagatcgtggcggacgtaaacaagccgacagcagaccagatgagtgaactgctgatgaaggaacgcgaagccgccacaatgaatgtggcttccgcgagacattcccgctaaacgcactatagaagcattcgaagaagggaacagaatccaccatgtggtccatcactttgaaactcatgcgaaaaaccaagcgcatgctcatacccgcaggcatcgccatcatgatcggcacggcgttcatcgccagcaccttcctgttcggcaatgccatgaacgactccctgacacggcagctgaccgccatgttcggaaacgccaactatgcggtgagcatcaacagctccgacctgagcgataaggaactcaacgaggcgtattccagcactgtcggcgactttcatctcgaccagatcgccggcatcgaaggggttggcggcgtccgtgcctcggtggaaaccggcgtcagcgtttccaagggagacagcaccgtcagcggcgagatcatttccaccgcggcacagaagaacatgctccccgtgaatatcacggaaggggaccagccgaaggattccaacgaagtcgcgctgccggaagacatggcgaaacagttgaacgtcggcgttggagacactgtaagcctgacctcccgatatgcggtaggcgacgatggcaaagccaaggcggacaacgtgcgcgtggtaggactcacgtccgatccgaacggcgcctactcatactatggtggtgcgatcgtaggatccaacaatctgcttgccgcaatgcagggagtggacgatttcaacgccaccggaacaacaatggtgtatctcgaccttgccttggatggaaacagcgtatccgcaaaaaccatcaacggtgtgaaagcgttgctgccaaagcatttcgatctgatgtcacgacagcaaatcagtgacgaaagcatcaaatccttaagcggcaaccaaaccaacatcgtcaccacattccttatgtgcttcggcgtgcttgccatgttcgtggcggctctggtgatcgccaacacgttccaagtgctcgtggcgcaacgccgccgcacactcgccttgctacgcaccatcggcgcaaagaaaggccaactgtatggttccgtgctgttcgaagcggtggtgctcggcttcgtcgcatccgtgcttggcgtggtactgggaagcctgctcatgtggggcatgtgcgtcagcgacatcatgcaggcgggtatgcggttcaacttctcctggcaagccgccgtcgtaccgattctcttcggcattgtggtgacggtgcttgcatccatgggatccgcacgttccgccaccgcggtaacgccattggaggcattgcgtccgattgaactgaccgacaaccgtcgttccagccttacgcgagccataatcggtattctgatggtggcggtcggtatcgccatggccatattctccatctggcaggtgcaggccaccaacggcggcgaggatgcgagcggcgatcaattcacgatgattctgctcatagccatcgccggtgccgcactggtgttcctcggcatggtggtcaccgcggtattctggatgccgaccctcatgaagggcgttggagcgttggcctcgctgacaggtccttccgcaacagttgcacacgccaacattcagaagaatccgcgacgcatcgcagcaaccggtgccgctctgctcatcggtgtcaccttggtctccaccatcgcaaccggtgccgctagcgccaaagagactatgaatggtgcgctcgccacccgttatagcgtcgacatcgtggccatgggcgatgacatcagccagcaaatggtcaaggatgtatctgacatcaacggcgtgtccgacacgttgtatgcgccggcggtttccgtgaccttggagaaagcggatggaacccagcctacgtccgcattgctggtcggcgtgaaaaacatcgatcaggtcaagcaggtcatgcgtgccaacttgggtaacgcctccatcgacagtgatagcgtgctcatgccaacatacaatgcgcaaaccggcaaggagctgcagttcgccaatggcacggctgatttctccactgaatggaaccagaacggcgacgctacgcgttcgctgacattgcaagccaaccaagccgactaccgtcgtgtatccgcgcaatatggagctgtcggattcgtggatgaaagccatttcaccaatggtgaccttgacgccgccacccatgtgttgctggtcaaggcagacactgacaagtcgggagtttccgttgacgacatctacaacgacatgcaggccgcattggagaagagcactgatgcgacagtgaccggaccgatcgccgaacgcatcgtatgggcgaacatgattgactccatgatgatgcttctggtggggttgatcgccgtggccgtgctcatcgcacttgtcggcgtagccaacacgctgtcgctgtcagtgatcgaacgcacccgagaatccgccacactgcgtgccatcggcatgacgcgaggccagttgcgacgctccctcgcggtggaagccctgctcatctcgctggtatccggcatctcgggcgtactgcttggcacactgttcggctggctgggcgcatacgtggtgttcagcatgtacggcaaagtggtgttcccgttcgaatggggcattaacggcatcgtactcgccgtggcagccgtggcagcactgctcgccagcgtattccccgcacgcagggcagtgagcacgcctcctgttgaggcgctcgccgaagcctgagcttcatagcaaacacaacgaaaaggactcctaccacaaacatggtaggagtcctttttgcgtatcatgcatacgcaaaacaacaaaccaatcagaccaaatggttttcgtaagcgaacaccaccgcctgtacgcggtcacgtgcattgattttcgccagaatatgcgtcacatgcgttttcaccgtcggcaggctgatgaaaagcttgtcggcaatctcctgattcgacaatccatgcgcgatctcaataagcacttcgcgctcgcggtcggtcaggtcatccaattccggatcggtatatgttgaatccgtagtagaagtagttgcggaattttcaggcctaccaacgttcgcagccatgaaatcgccttccatcattttctcgataagacgtttcgtggcggacggtgcgataatcgcattaccttgaaaaaccgtgcgaatcgaattcagcaatgtttccggttccgtatctttcagcagaaaaccggaagctccggcagtgatcgcagccataacatattcatccaagtcgaatgtcgtcagaatgatcactttggtatgagtgacttctgattgcgttccatcggcagcgaagcgatgccgcaacgcactgatctgccgggtcgcctcgataccatccatgccgggcatgcgcacgtccatcaacaccacgtcaggatgcagcgtttccgccaacgccacagcttccgcgccatcgcgagcctgcgccgcaaccgccatatcaggttgggagccgatcaccatggcgaaaccggcacgtaccaattcctgatcatcggcaatgaccacacgaatcttctgttcctcgctcatactctccaccttatcggcattgttccgctcacagcgcgaaacaaacccttaaatctccctgaaaaacttgaatcggctatcgagacacgcgctgcagctgctcctccaacggtgctgcgggcctcaactgcagttcgctcgcactaccggcatgagcgtcatcgctgaaaccagtctcacgaagcacgccaagcagttcgcgcatacgcttgagcgcggcgcgcccctgctcgccaatggctttgaacgctgcggaaatctcgtcggcggtaggctccttgccttgtgcttcggcgctgtccaacatatgaataccatcgacggcctggctgatcacgctgttcaacgtggcggtgacttcagcctgaatgctggcactgatacggtcacgttccatattcgccgcgagaatacgctgcttctcctgctcggccaccagtgcctcttcgcgagcctgcaataccagtgcgtttgaatcgctggaacgcgcccaacgtgcccacgccatgatgccggcgcacagcatcagcactgcaaccgtatacatgacaccggtaaagaacgctgcactactacttgacgtggctgaaaccggttttgttaagcccgcggaagcggcgatggcgccgaacaaggtagtgtatccgtgctgatcagctgcgattttcaagcccatcagagctgaacaggtgacagcggcaagaccggtccagcgccatgcgtgttcacgcccatacaatacggctgaatacagcgcacacagcgacgctacgatatgtccaacctcaatcaatcccaaaaacaccaattgcacaaccgacaatacgaacacaataagcgcgcaaatctcggggagccttcgtcgaagagccagtgccagcaagcagcatgcggcgatcgcatgagagagctgcgcatcgcgtgaactatcaaaaaagaacgtaatcgacatgcgattcagcagcatgaccaatatcacggcgccaacggaatccatgagcacataatggtgctgcgtccacgcggaaacacgttccacccaattcagccctcgcgaattggatgtattggcaagttctacggatttcagtttcaacgatgtgagcaaatcatgcagattgggtgcggtaatgcgcaagtgttgcagggcgttcgaacgatgatcgcgaccggttggtgggttggtttcctgcgtctgttccgatggttgatctgggattcgcgccgatatgttgacggctgtgtgaggtgcgattgcttcgtcggataatttcgctttgctggatatggcagttgtgttgcaagattcggactgttccgaggcatactgttcgccggtttcgtctgtcgctggctctttaccgccgtaaggcagggtggccataacttcgaagcctccgccgagttgagggccagcctgcaatgagcctccggccgattcgatgcgttccttcatgcccaacaggccgtaacctggcgtatgcccgtcgatattggccgccgcgccacgaccattgtcggtgacgctcaaagtgagcaaaccgttgttccatgactctttgatatgcacatcgacgtgcggccccgcatacttgcggatattcgtcagcgcctcctgcactacatggtaggaagctatcgaggcttgttcaccgagttgttctgggctggcggtgccggtgatattccgtcggattcgaatgtcgggggagacgtttcgcgcttgttccacaagattgccgatatcgttataatcggcgtgcggtgaacccccgaatactcccagaagacgttgcatgtcatgcagtgcgcgttccgattcgtgtcgaatcgtctccatggtgtttctagccaccgcgggatcatgcgtgcctgcatagcggccgccatcagactgcacgatgatgattgatagggtgtgcgccaccacatcgtgcatgtcacgtgcgatgcgtgctcgttccgccaacgcggcgatatcgcgttcgtcctggtctcgcgcggcgattgcctcattgcgttcccgcatcatgcgaacggttgccagacgggcacgctgccagaacgctacaatgacggtggaaatgatacatacttcgaaaatcggcgtcagcaccagcatgtattgcgccaccatgtcggcgacttccgacatggatgttcctgtgtagatggagccgagagtgacttccgtgaccataacgccatttggatttgagccattccaactgctccacgtatgcactttgccaccggtgagcagcggcccattggtcatggtccatgccatcaacgccgaagccagaagaccgatggccaacgccaaaataatgaaggctttcgtgtttttgggattgccgtagacgatcaccgaatacagcatgaccaatgccagaatatcggcgcccaatatgcaagggccgaatatgagatgcgtcaaggccaatgccacacagagcaacgctccggtctgtggccgccatcgacgaatcagcagcgggatcagcattgccgcttcccacgccatctgtatggaaggattaaggtcaaacagcaatcccggattataggtgatgctgccggtcacgccgaacagcagaacacctataacaagcgtgaggatgagatcgcctgcgaagacatgaccatgcatccacgacaagagacgctgcttgaaattcgacatatgctccaccctagcgccagatacgctgtggcgccatcatgcgcaggaatgaaatggcggtaagataaagccgcttttgtgaggtaaggttgtctccgcgtgtgggtgggatggaagccatcaagaagccactactcgcattgaatatgccgatgacgccaaaggaaaggtgaatgcatgacgttgctgagcgaatactacgtgcccggattgcatattgaggatcgttccatcaaggtgccgttggattggacgggccacgagcccggtcatgggttcgatggcgaatcgatcagcctgttctaccgtgtggtcaccgctcccgaacatgtgcatgacgacctgccgctactcgtgttcctgcagggcggcccaggcggttccggtccacgtccgctcggcccaagttccgatggctggatcgaggaagcgatcaagcatttccgcgtggtattgccggatcaacgtggtacggggcgttcgtctcgtgtcgacacgcatgtgattgagggcatggacggcgacggcaaggccggtgccgcgtttttgaagcgtttcctcgccgattcgatcgttcgtgatttcgagcatctgcgtcgcaccgaattcgggggcgcacgttgggtcacgcttggtcaaagctatggcggattcctgacattgacgtatctttcgctgttcccgcaaggggttatcgccagcttcactacgggcggcattcctcacgttcccgccgatgcgaccgacgtgtaccgtcatacgttcccgcgcatggcggcaaagacgaagcagttctacgagcgctacccgatcgatatcgaacgtgccgctacggttgccgacatactgcgatctcgcaaggtcacattgccgaacggcgatccgctcacggtggaacgcttccaatgcttgggatccgatttcggcatgaagccgagtttcgaacgcgtgcattggattcttgaccaggcgttccttgacggcgacggttcggcctcggcctcggcggaactgtctgacgagttcctgtcttccgtgatggatgcgacctcgtctcgtccgctgtattggccgttgcaggagttcatctacgccaatggcgagctgaaaacgccgattcgctgggccgcccagcgcgtgcgcggcgagcatccggaattcgcgggcggcattcgtccgcttaatttcaccggcgaggccatgttcccgtggatgttcgagcaggaacgtgcgttgcgtccgttcaaacctgccatggacgtgcttatggaagacacgcacttcggcacgatctacgatgccgaccagttggctcgcaacgaggttccgctgcaggccgccgtctattttgacgacatgtacgtcgattctggattgcagctcgacacgctgtctcgcgtcggtcgttcacattattggactaccaacgagtttgaacatgacggcgtgcatggttccaccgtgttcagacatctgtttaccgaggcgttgaaccgcggagatttggcggagttgttctgacgattgttcggcaacgacgagtatcgatagcaaaggaaagaaacatggccaatccaaccatcggattcatcggatacggcaatatggcacaggcgatcgccgaaggcctagtcaacgctggcgtcgtcaatggcggcgacatcgtggcctgtgccgcgcattacgacaagctggaacgcaacgccgccaaactcggcgcaaaagcggtgcgtaccgccgcgcaagtcgccgaagcagctgacatggtcgtcatcgccatcaaaccgtatcagatcgaaaccgtgatcgcaccgatcattgatcagctggcgcaagagaacaccatcgtcgtgtccattgcggcaggctgggatctgaacaaattccgcgacctgttcggaacgtctttcgaacaggcacacatccaatgcaccattccgaacacgccgatggctgtcggcaaaggcgtgctggtcacggaaatcgacaacacgctcacgcaggaacagacggaaaccttcgaaagcctgttttcgtcaatcagcctgattgaacgcgtggacaccgcacacatgggcatcggcatgtgcatcgccggctgcgcgccggccttcaccgacatgtacatcgaagcattgggcgatgccggtgtgaaatatggattgcagcgtgctaccgcgtatcgtctggctgccaaaatggtggaaggcgtgggcgcgctctatttggccaacgaaacgcatccgggtgccatgaaagacgctgtctgctctccgggaggcaccaccatcaggggtgtcgcatcgttggaggaaagcgcgttccgtggtgccgttatcaaagcagtcgacgccatcgaagcctaatactaagctagggaaccatgtctcttactatcggaatcgtcggactgccgaacgtcggcaagtccaccatgttcaacgcattgacccgcaacaacgtgctggcggaaaactatccgttcgccaccatcgaaccgaacaccggcattgtgccgttgccggatgaccgtctgccggtgctcgccaagctcgtgcatacggagaagatcgtgccggccaccgtcacgttcgtcgacatcgcaggcattgtcaagggcgcttcggaaggtgaaggtctgggcaacaagttcctcgccaatattcgcgaagccgacgcgatctgcgaggtcgtgcgtgccttcgaagacgatgatatcgtgcacgtcaacggcaaggtcgatccgtccgacgacattgaaaccatcaacaccgagctgatcctcgccgatctgcagaccatcgagaacgcgctgccgaagctggagaaggatctgcgcggcaagaagatcgaaccggcttacatggaagccgtcaagcaggcgaagaccattcttgaagctggcgaaaccattgataaggcgactcgcgaaggtcgtttcgacaaggattccgtctacgatctgcacttgatgagcgccaagccgttcatctacgtgttcaacgtggacgatgccgaactgcagaacaaagacatgcaggccaagctcgccgcatccgtggctccggcccccgccatcttcctcaacgcgcagttcgaagccgatctgaccgaactcgatgaggccgacgcgcgtgaaatgctcgccgacgccggtcttgaggagtccggcctggatcagttggcgcgagtcggctacgatacgctcggcctttccaccttccttaccgcaggtgagaaggaagtgcgcgcatggcagatccacaagggctataccgccccgcaggctgccggtgtgattcacacggatttcgaaaaaggcttcatcaaggccgacatcgtctcctacgacgatttcgtggctgccgaaggctccatggtcaagatcaaggaggaaggcaagctgcgtcaggaaggccgtgactacgtgatgcaggacggcgatatcgtcgaatttaaattcaacgtctcgaagtaagtgtttctctggttcccctctttgaggggagctgtcgctacaagcgactgaggagcggcacggataaggcctgagaagtcgtcttctcaggcctttgtcatgacattgttctgcaaggactggctgctgcagcaacataatgtgtgttttattattcggccttggcggcttgctggtcaatccaattgttgacgtcggtgatcgcctcgtcaagggttgctttggcggctttgtagtatttggaatctacaggttgacgatttccgcgccgaacggccagagcgcaagcttggccatcttgaatgattgcaatccgaacggaatgccgataatggtgatgcagttgagcacgccggctcccagatagccgagcgccatccaccagccgaccagcaccacccacaggatgttggccaaggcagagccgactccgccgccgtattgtacggttgtgccaaacggcgtcagggtgagtcccgccatcttgaacgcttgaatgccgagcggaatgccgatgatggagatgcacagaatcagtcccaccactgcccatccgattgcgatggccaatccaccaagaatgatccacaggatattgccgagaactcgcatgatttgcccctttccgattccggtcgatgcctcgcatgttcagcttcactattttgccagacatcatgacggaaacacgagacgcaacccttagctcgcctctgattcatccccggaccgttattcaggcggatcgtatgcggtaagcccgatccttttgtgaagattttgtgtattgtcgggcatgcgtgggtttcaccgtcgatttgaatgatgataggcttctcgatgtctgccgtacgaagacccatcaaggagatgccatgaacctgtatcgctacgcgatgttcatcgcacgcgcctgccgtgggtcgttcgtcggcaatgttctgtttgccaatccacaaatggccctattctcgatgctggtgtagcggggacacgccttatgccgggatgtaccgatggcccatccgcagtcggcgtcgcatgaatcgctcaccatagccatcaacttacgcaaagccgcgaatcgtttgccgtatatgaatgcggaacggatggcggcttttcctttatcccggactcatcagtgtccccgcgtcttgacacaagtatggggccggatcacccacacatgccgttaccaacagaaggaaatgctgtgacctcacagaaaaccgcggaattcgggtccgccgccagttccgtaaagcctattgatccgcacacccgattcatcatcgtgggcgtgatcgtcgtcggctcgttcatcgcgctgctcaaccagaccgtcatgtcaccggccttgccggcactgatgcgtgatttcaatatcaccaccggcaccgtgcagtgggtgaccagcgtctacatgctggtctcgggcatcatggtgccgatttcaggctatctgattgataaattctccacccgaaagctcttcgccggagctcttgccactttcatggtcggcacactgctgtgtgccgtcgcgccgaatttcatgctgttgctcgtcggacgcatactgcaatccgccggctccggcgtgctgttgccattggtcgccgtagtgccgatgctcgtctatccgccggataagcgcggcaccgccatgggcatggccggtatcgtcatggccgccggcccggctatcggcccggttgtcggtggtctggtgattgacagtttcggatggcgcccaatgttcgttggcatcgcagtcgtggcactggtcatccttgtcggaggcacgatgatgcttaagaacgtcggcgagttgaagaacccaaagctcaacatcctgtccgtgatcctttcgaccatcgcgttcggtggcctgctctatggcttctcgtccgcttccacgatgggatgggccagtccggtcgtcattacctcaatcgtcgttggtcttgtggccttcgtcgcattcgtatacaagcaagtcaagctcgatgagccattgttgcgcgttgacacccttgccacccgcaacttccgcaactccgcgattctggtcactctgattaacgccgcagtcgccgcaaccaacgtgacgttgcctatcttcatccagaatgtgctcggccaatccgccaccgtcaccggcatggtcatgctgcctgccgcggcggtcggcatcatcctgagtccggtcgccggtgccgcattcgacaaattcggcccgcgcggcgtgggcatcggcggccttgcgctcatgaccatctctcttggtcttctcggcaccatcaacaccaggacatcagtgctgtttgtcgccgtgttctgcgcattgcaggcatccggtcaggctatcgccaacatgccgatcaacacttggggcgtcaacgctttgccgaacgacatgatcgcccatggcaacgccatcgccaacaccggccgccagatcgcggcagccattgcgacctcgcttctggtcaccgcagaaacatccgtgaccgcctcgcacatgtcccagggtgtgaagtccgccacggccagcggcatcgcgttctcctacctgctgtgcgccgccatctcgctggtcgccctgatcatctgcatcttcaccgtcaccagccgtgccaaggagaaggccgcacgcaacgccaaggcctacgaggcgcaagcctccgccgaagtcgcggtcgaaaccactgaaggccagcccgccgagcatcactacgccggcgcatacgtggcccccgccgcctccctgttcaagcaggcccaggaacagtccatcggcgggatcatggacgatcagccctacagctgcctggacagcgatgacatcacgcatgtggtgcgcgagttcatccgcctcaacgtctccagccttcccgtggtgaacggcgatggcaggctcgtcggcttcgtcagcgacggcgatgtcatgaaatcgattgccacctatgaatcccgtacggttcccaccggcaccggttcgacgatggtggtgttcgacgacgaaaccgtggcctccaaggtgcaggcgctctccggcaagaaggtgatggacatcgccacgcgtaaggtcgttgccgccacgcccgaccagcatgttggagaggtggcccgaatcctcgccaagaagcagttcaagaaactgccggtggtggatggtgatggcagactcgtcggtgtgatccgccgtaagtccgtgatggaacatgccttcgacgcgctgttccccaaaggatgatcggtgattaggcgccatcatcgctgaatagaatgaatggaacatgaggcttcccttctcgcgggggaagcctcattgctttgtccgcggagtcttacggcacctgcgcaagggcaacgtcacgccttcatgatgcactattgaatagtgtgttcctatcgttgcatggtgacgctaacgcatggcgtcacgatactgaagcctgccgtctaacggcgggtatggctcgttgctggagtcgtgcacgcatacgcgcgtcggcgtgcgtatgccgtgatgtgacctttgtagtggaattgaagaattgaggcttctgctgttttcgtgggttaggttcttggttgtggtaggtgtatgtcgagtccgccgcagcggagcatgacgagcgcgatgaggctgctgacgtggcggaagccataggtcatgcggatggtgaccttgatgcggctgtggggcttcatccgtggagccagcgtgatcatcatttcgacgatcacggcgctgtggctgttgcaaggcattcccgtggtcgccggcacaggcggattcacgcacgtcgacgatgtgcatgaatccgcgtatggtatgctcgccggcgcggccgctcctgtgttcgcgccagccggttttgacgactggcatgcctcggccgcgttgatcacgggattcgtggccaaggaggtcgtggtcggttcgatgtcgcagtcctatcacgcggacggagcggatgatacggcttcccgacaggccggagaggggacgttgggacagaagctgcgcgcctcgttcgaccaatcgtcatacggtcatggcagggccgcagccatcgccttcctgctgttcacgctcgcctacacgccctgcctcgcgacggtcgcggaaatgcgacggcaattcggcacgaaaatcgcggcgcgttccgttccgctgagtctggccgtggcctacgtcatcgccgtaatcgccttccaatcattgcgattgatatggtgaacggtagaggacggttcgacattcctgcacgtggttggcgactcacgtcacgtacggtcggcccgcaggacaatggtcagggcgatatcgttacacgtatcgtcggcgatgttgcggcaggattgacggtgcggtagatcgccgccgaacgacatctgccggtcgatttcgtcgacatggccatcgaacgcgcgcgagaacgaggatcgcttgacgtggtggatatgcggtcgcggcacgcctgcggagagacggtatgccgacccgaccccgcttcgttggtgtgcgtgggatgcccattcaggtttttcccatcttcggactcgtaaaataggagaggttaacaagacgaagaacgatgacatccgtcgattcgcaaggggtggacgcatatggattatcagtatcaggccgttgaacagccttccaatccccgcaaaacctggccgattgtcctttccgtggtcgtggcgctcactgtggcatgcggcgcaggagtgtacgtctaccacaacaaacggcaggaggcgttggacacatgccggcaatcgcttgcggaattcagctcggcccgtaaggccgtgctcgacacatccgaaaacggtagcgagctgcagaaattgatccgtggtgcgttcggcgtgaacgacatcatcgacgcgttcgcggacgcggccaccagcgcagagaacacggtcgatacggaaggctgtaaggcggacgccaccatcacgcagctcaatctcatcgccaaaacactagacagcgccacggactccctgaataacagcctgaaggacatccaggagaagaacggcacgaatgcgctgcagcaggattcgcagaacgattcggatgacacgacaacgaacggaccatcctccaatactcagtccaatacgtcatcggggcaattgctcgacgttccttcgaacggttcttccgccacggaatcgttggatgaatcgaagaaggaactgcagcagtcgctcgataaggcggacaaattggtcaacaagcttggcaaggacgaaacactgacgttgactggccgtaaactgctgtccgcattgtccaaagctgtggattccggtcaaaaactcattgaaaacagcaatatcaaggattccaagtactacaaggcagccaaagtcacgctcgatgaggccatcgatgtggccgagaattgggtggacagacaggcgtccaaagcgcaatgacgattctccctcgtgttgcttccatacgcgcgtctaaagtttcccggaaaaacgtcgacgattatgacatcagagaatatgacgccatgacggatggaagcgtaagaggggatacgaatggcgaaatcggggtgtgggccgtcggggaaacatcgcgtttgcgaacccggtcgcccgtccatatcctaggcgatcgggttcgaaagaccgattagaagaacagcgctgagactccggccgcaaagcacataagcagcacagacgtgatgaaactggcgaggaacgccttctgtcccttcttggcgatggcattgaaattcacgttgatgccaagcgcggccatggccatgccgagcacaatgtatgcgaaatcgaccagattcggtgtgatggcaccgatgaacggcacgaacgtgccgatgatggaagcgccgatgaagccgagcatgaaccatgggaacgacactttgcgtttaccgtccgctggcatttcggaatggtttttatcccaccaaacggcgatgacgatggctgcgaacaccagcatcagtactcgcgacagtttcatgatggttgcgatgtctaccgcgccgaacgcgtcgccggccgccacggcatgggcgatttcgtgcaaggaagctccggcggtaatgcccagctgtgtcttactcaaaccggtcaatggtccaagggcgatttccagtaacgcgaagatggtgcccatgatggcgatgatggccacggccatcacttcgttgttggctttttcatcctctttttccggcggtaccttgatggagccagacaatcccatgacggcggccgcgccgcaaatgccggtgccgcccgccactagaatggcgagctgcggatcgacgccgagtttacgggcgatggcgtagcacaccacgatggtgagtgtcacgaccacggccgcgatgggcagacacttgatgccttgggtgaacaatacggtcagattgagcttgaatccaagcagaatgattcccagacgcaacagtttattggaaataagtcctgctgcgtccttcacgccggacctgtgttccacggaacggctggaataccatttgcgaatcggaaactgggccgccatgccgatgagcaatgcgatgatcagcgcgccgaacagactgaatcccggaaactgtttaagccacgaagccactagtgaggcggccaaagtgacgatgccgacgaaaaccatttccttggtggctatgcgagcccaccatgttttgcaaaaatcaatcacgtgtctcaagtgttccggccggttcggacatcggtatggtgcggaaagcgatgacttcagcgccgtgccaacgatactgaaatccaatgcgcgatcggcagcaggtacaggaacactgccaatgtcagactggacgtgggcgctcccactgaagcgagcggcaccgctccggcgatggaccatggaatcagcggagccaccaccacggcggtgtcctccagattgatggccttgcgatgctcgtcggactccagatggtcgcatagctgatttgtcagcatgatcgacaacgtttgattgcaggcgacggcactcgccacgagagacgttaccagcgtggcgccgaatacgctgatatgccgggcaagtgatgcgaccatccgatgcgcgccatccagcagttccgtctcttggaaaatgccggaatatgacgatgaaatgcatacgatcagcatcactttgaccattgaaacgattccgccgccatcgatcagcggtgcgacgcgcgcgtcagcacagtggaatccgaataccagtgcgtggccaatcgcggtccaatccatatgttgcactgcaacgcaaatcggcaatgcagtcagtatgctggcggtcatgatgatgcgcacgtcaaccctggcgatcgccagcgcgaccaacaccactgcgggcaggacggtgacccaatcaagatcgaacgcgttggaaaacagtccggcaatgtcaatggagccgttggaaggatgcgtgcacagcgccaatgccgcatacactgcgcacgtcagcacgaacggtaccgcggcggttttcaacatcagtcggatattgtcgaaaatgttcgtgcgcgtcagcgttttgaccaattgggcgctggtggatacgggggagcagcggtcgccgaaatagatgccggacagtatcgctccaccgaggaacaccggtggaacctgcatggaagcgcccaacgtcatcgtgatcacacccatcgtcgcagccgaagcgaacgatgatccggtcagtagcgacatcagacagttgagcaggaacgtgagtaggaccaccacatgaggatgcaccagacctgccgtattcgtcacaatgaacgacacagtgcctgcggcgcgccacagggtggtcagcaggccgatcagaacgaacgttactaccacgatgctggcggcacgcatggtcgcgaaacctttggaaatcatggcggtgaacgtatgcccggtaagacgcccatgagctaggaagatcaccacgccggccaacaacgccggaataatggaaatgccggcgataatgcaggcgatcaacgcaccacagaacaacgccattgtgatgagctcggccatggatacacgtccttcctcatagatgccatgcgaaacacctcaccagtgaacccgattggcatggttgatgcgtggactgtttcgatatatgactatcggtgtggcatgtggccgttgcgctgcgtcggtttgcttcaagtcgacttgaagttggtaatctggctctggaagcaaaatcgaacagaataaggagaattcatggctgatttcgaagcaaggaagctggacgaattggatcatcgcactgatgatgcctccgcgcccgaagtgttcttcacatctgtgatcacgccggaaagcctgatcggagcctatcatgcgctcggacgcaagcctcaaggcaacgtggccattaaaatccattccggcgaatcggagaaatccaataacctcaatccggcgctcgtcaaggatctcgtgcaggagatcggcggcacgctcgtcgaatgtgcgaccgcatacgatggcaatcgcgaaacgcctgagaaaagccttgccgtgttcaaggaacgtggatacgcggatatcgcaccgatccaaatcatggacatgggcggtgaaatcgaaattccggtagccaaacaccgtcatatcgcctatgacatcgtcggcaagcatatcgacgactatgattctattttcgtgctctcgcatttcaaggggcatccgatgggcggcttcggtggcgcgctcaaaaacgtgtccatcggcatcgcatcgtcgaacggcaaacgctggatccattccgcgggcgtggccaccgaccactgggtggaagccgaccaagatgacttcctcgaatcgatggctgaagccgacgaagcagtgatcagccacatgcatggcaacatgatgtatctgaacgtcatgaaccgcctgtccgtggactgcgactgcttccccaccccatccgaaccggacatgcacgatatcggcgtgttgtcatcgcttgacccggtggcgctcgatcaggcatgcgtggaccttatccacgttgcccccgacggagcttccgtcaccgaacgcatcgcttcccgccacggcgaacacacgctcgaatacgccgaagaactcggcatcggctcacgctcgtaccgtctgaccgtgctcgactgacagtgtccgtaatgaccacgaaaccggcgggaacaggcggtgtcgtaatcgcccatattgaagcgctgcttgccgaacgcgaccatgtgctcgttgcgatagacgggccatgcgcatccggcaaaaccatgctcgccgcaaccgtcaacaagcgtttcggcggcaacgtgctgcatatggacgatttttttctacgtcccgagcagcgcacgccggaacgattcgcgcaacccggcgggaacgtggaccgcgaacggttcgaaacggaagtattggctccgcttttcgccggaaaaaccgtgcaataccgtccatgggattgtcattcgggcgatttcgcggtctctcgtaccgtcgaaccggctcggttgaccatcgtggaaggcagctacagcatgcatcccgatctgcgcgggtactacgattgcatgatctgtcttgcgattacgcctgctgggcaactgcgtcggctcgagcaacgtaatccgagcatgctgcgacgtttcgtcgacgagtggattccgttggaaaaccgttatttcgaagagaccggaaccgaatcggctgccgacatgatcgtcgacactgcattgccggataacgtatgacgaccattgaagagaagaaaacaaaaggagaatgaatatgtctgattctgcaactatgtccgtgcgcgctttgcatcgtaccgacctgccgaagctgagcctgagcaccaaagccgcggccaccgtgttggccattgtggccgcggtcgcattgccgcagctgttccatgttatcggtgccgtttccgggcagggcaccatgcttggcgtagcatttctgccgatgcatctgccgatcatctttgtcggcctgattgccggtcctgccgtcggcgccatcgccggagccgccgcgccgctcgccagcttcctgctgtccggcatgccgatgctggcgatgctgccgctgatgatggtggaattgtgcgcgtatggtcttgtggctggtttgctgcgcgaagtcaagctgccgagtcttgcgaaggtggtcatcgcccagctggccggccgtgtggtgctgaccgcggccactgcgatcgctgtgttcgcattcggctcaagcaaggcggtcgccgcaacatggacgagcgacctggccgccggtctgccgggactcgccttgcagtgggcgctgatcccgctcgccgcctactggatcgagtcgctgattgccaagcgcaatcactgaacaacgatagttcaaacgcggcagtcagccacgttctgaacaaaaccgatattttcgggagccaagccattacgcttggctcccgttgtcatatcagtcgggaaatcgggggaaacggtcatgatcgcgggagtgtccatcaccacattgctgctggtgctcgcagccggcatcggggcgggattcgttggatacgcggtcggcgcatcctcgctgatatcctatccggcgttgctggcgttcggcattccgcctgtgctgtccaacaccacgaacacggtgggcgtgtgcggtacgggcatcggcggactgctttccgcccgcagggagcttagaggccaaggcgtgcgcgtggccgtctacgcctgcatcggattggtcggtggcatcatcggcgggctgttgctgctggaactgccggcagaagtgttcgaatgcgcggtgccaccgctgatcctgttcagtgcgttaatcatcgctatcaatcctcggaaaaaagctgctgcgcgagatgccgtcgcgcaagcgcttcctcaatcgcagcaaggcgaaagggctgcacagatcgccaacaaaaccgatgatggcaaactgcatgacccatggtggttgtggcttggcgtaagttttgtcggcatttattccggatatttcggtgccgcagcaggcacgcttgccttggcgattctcgacttgggtaagatcggtccgttccatcagattaatgcgttgaaaacggtggtcggtttcggcgcgaatatttccgctgcgatcatgttcatcattcgtggatccgtgtattggccgttcgccatcataatgtgcatcggatgtatcatcggcagtgccatcgcacctcccgtaacccggcatattcccgaaaacatcatgcgtgccgccgccgtgctcaccggcatcatcctagccgtcaaactcggctggagcacctacttctaagcaaaacagatcagttttgtgagcaatggagatatccttgaaagaaggtagttacaaaacggcaggggagcaatggcgattgtcgatgaggcgaagctggggtatctggactttctttcacgtgaggatcgggtacgccaccatcgctacgttgaggaaatgaagcagtatgacatgatgcgctccggcgacatcaatgccatttctgaaagtgcgaaactgtgggattccggactgtacgggcatctgtcagacgatcctctgaaaaatgcgaaataccgtttcgtcaccaccatcaccttggccacacgcttcgccatcgaaggtggcatggatgaggaagacgcctacaacgcttccgacctgtacattcaggatcttgacaattgcaagaccccggaagacgtgcgccgactgcataccgacatgatgaccttcttcacctgggccatggccgacatgcagaaaaccgacacccattccaaagccgtcaacgaatgcatggactacatccactaccatctgcatgagaaaatcactgtcgcgattctggcacagcacgtgcatttgaatcccacgtatctgtcggaactgttcgcacgcgaaacgggaacgtcattgtcgcaatacattaccgacaaacgtatggaagccgccgaaaacatgctgaaatattcggaatacagcttcaatgagattgcgcagatcctcgcataccggtcgcaaagccatttcacgaaagtcttcaagaaacatagcggcatgacaccgggggagtaccgcgccaagtactcacagaacggcatctggccggagtagtagcgccccggcgtgtcgcgggcgatgcggtgaaccagacgtaacgacatctcgaacttcggttgtgccaatcgtgaaatcgatgtggtttcgcgtgtggcatacgttcgaatcgactacggtgaaagcattcaatgatgatgcgcgccggccgaatgaacggcagaacggaaacgcgcgcaggatgtgtggatgaaagtaaaggaataaacgaatatgggaatgccccttgatttgtatgtgattcgacatggcgaatccgaagcgaacgtgattatcagtgccggtgaacagggtgacaactcgctgtatacgcaggataacgtcaccgtgcccgaccgttcgtggaggcttacggccaccggccgcaagcaggcggactgcatcggccgctggctggtctcacagcagccgttgttcgaccgctacctcgtctcgccgtacgtgcgcacacgtgagacggctgccacgatggccctgcctaaggcgaaatgggaggagacacgcgtgctgcgcgaacgctcctggggtgagatcaataccatcacgaaagacgatttcaaaaccaattacgcgcgtaactggatgttcaagaacactgatccgctgtattggcgtccgccggcgggcgaatcgatcgccgatgtggccgaaaaccgcgtgcataatctgctcacatccctgaaccgcaagtcggacgcggaatccgtggtgatggtcagtcacggcgacctcatgctggcgcttatgctcactttggaggacctgtccgacgaggagtttatgcgccgtgcggcgtccgacgaatggaagatcactaattgtacgtgcttccattattcgcgccgtgatccggcgaccgggcgtacgtataagcggttccgttgggagcagaccgcgcggccggtattcgatgaggcggaaaatcgttgggtggtgaaagtggatgattggcgcgaattcaaacgtccagtgctgtcgaatggcgatttggtggacgttgttcatgcggttgaccgtcacctgtgatgtgtgttggtctgttgattgcatgatcagattggctgatatcgacgattgatgccccccatcttgcgtgcgcaacgcgcccgtgtccacgccccactacaatggctgtgacacgcggcgcgtttttgcttgccgcgcaagagagttaaggagacaatcgcatgtccaatctgttcacgtggcaggtccacggtgacggcaagacgctgaagccgggcgaagtcgttgagcctgacgagcgcctgacttggccgcgcaccgccgaaatcggcgcacagcatgtcatcgccatgttcggcgccacgttcctggtgccgattctgaccggtttcgacccgtccaccaccttgttcttcacggccatgtcgaccgcgctgttcctgctgatcaacaagaacgtgctgccgagctacttgggttcgtccttcggcttcatcgcgccgatcgccgctgtggccagcgcccacaagggcctcgctgtcgcgtccttcggcatcatggtcaccggcatcctgctggccctgatcggcgtgctcgtccattacgcgggcgccaagtggatcgacatcatcatgccgccggtggtcaacggtgccattgtggccatcatcggcttcaacctggctccgagcgtgtggaacaacttcaaggtcgctcccgacaccgccatcgtcaccctcgtggccgtgctgctcgtcgccgtgttgttcaagggtctgctcggccgactcaacatcctcatcggcgtgatcatcggctatgcgtacgcctgcttccgtggccaggtcgacttctccgccatcggcaaggccgcatggatcggcctgccggaattccgtctgccgcaggtcgacttcaccatcctgccgatgttcatcccagtcgtgctcgtgctcgtcgccgaaaacgtcggccacgtcaagtccgtctcccagatgaccggccgcgactatgatgaccagatcggcaccgcgctgttctcagacggtctcggcaccaccatcgccggcttcggcggcggttccggcaccaccacgtacggtgagaacatcggcgtgatggctgccaccaaggtctactcgaccgccgcatactggtgcgccgccgcgttcgcgctgattctgagcctgtgcccgaagttcggtgccatcatcaacaccattccggctggcgtgctcggtggcgtgaccaccctgctgtacggcatgatcggcatggtcggtattcgtatttgggttgagaacaaggtcaacttcgacaagccgctgaacatcatggttgccgcaatcaccatgatcatcgccatcggccagttcgcgttcgcgttcaatggcatttccttcaacggcatcgccatcggcaccatcgtgattctcgtcgcctaccacggtctgaaggccgtcggcaaggccaccggcacgatcgacaagaacgaccccgacatcctgtgatgcaataatcgtttgcatcgctctgaaggcccttcccaaacgttccctgttccggaagggccttttgcgtacgcctgtgtagctttcgcgtgtgcaaggcattagagatgcgatgaggatatgacgattattgagaagtttcaagatgaaagcatacgtcggagtcttcatcgatagggcatctctgaaatttggttgtacgggtctatggctcatggggatacgaaatatgtgggctcgctgaaaacggtgttgaatgtgttacgtcaatcgtttgacttcatgtggggttgaacggttatgatggtgcaagaggggttgtgttcatttttgagtgaggagttcgtcatatgagtaccgcagccggaaagaaaatcgctatcgtcaccggttccgcgcttggattgggatacgagctggctcgacagttgatcgccaaaggatggttcgttgctggtattgatttcaatggcgcacgccaggcggagttgtcgaagacttttgctgccgacgaatacagagcttttgtgggcgatatttccgacgaatcgttcgtgaagaactctgttgccgcaatctcgaaaatcggtcatatcgatttgctgatcaacaatgccgggcagccttcgttcaaagtcccgaccgcatacgaggcggccgatgtggacaagtgtctgaaggggctgaaaggcatggtgttgtggagtgtggaaacgctgaaagcagacggtgagcgggatctcaaaatcgccaacgtcatgtctactgcggcaacgcgaggcaaccccaacgaatccgtgtactgcgccaccaagtggggtgagaagggctacaccaagagtttgcaggccgcatacaaggggaccagtgtgaaaatcgtgggggtctatccgggtggcatcgacaccccgttctaccgtgacagccatgactacgtttcagaagaaaagcagcataccttcatgcgtgccaaccaactggccgaagtgattctgttcaatctggtcaacgaagcaaatctgaccgtcaccgatatcgaaatcaaccgcaatccggcgtgaatataacggatatgaaggattgaaggaacgtaagaaaaagtatcgggcataggctacagttattaagtttgcgcaacgtgcgtaatatttgacatgaaaggccattgtgcccgataccgtttttgatgaagataccctcgcagccgcttccgaagtgatgggcgaggaagaggaacgcccgctgacattcgccgaactcggcgttcctggtccgctggtccgcgtgcttgcggctgatgacaagaaaaccgcttttccgattcaggccgacacgcttcccgattcgttggctgggcgagacattcttggccgcggtcgtaccggctccggtaagacgttggcgttctcgattccgctggtcgctcgtctgggtgaagtggatgccaacgaatatgagaatatgagccagttccgccatgaggttgatcgtgtgaagcaggctcatgccaaggagcggcgcgccgatgatttcgtgcctcatccgcgtggcttggtgcttgctccgacccgtgagcttgccaaccagatcaacgatgtgttgatgccacttgcccagatatacggcatcaacaccaccaccgtgtatggcggcgtacgttatgcccgccagatccgtgaccttcaggccggtgccgatattgtggtggcttgcccaggtcgtcttgaggatttgatcgaacagggcgcgctcaccttggacaaggttgaggtcgcggttattgacgaggctgacgagatggccgatatgggcttccttccgccagtcaagcgtctgcttggccagatttcgttcgacgcgcagatcatgctgttctccgccacgctcgatcatggcgtggacgaagtggtggacaccttcctgtccgatccgaaggtgcacagcgtcgattccgcgacggcgaccgttgacgagatgacccaccatgtgttcaaaaccacgcagggcaaccgtcacgagctggtgcgcaccctcgcttccggcaagggccgtcgcattctgttcacccgtaccaaattccagacgcagaagcttgccaaggatttaacgcagaacggcattcctgcggcagaattgcacggcaatctgagccagaaccagcgtgaccgcaatctggccgctttcaactctggcgatgtgaacgttatggtggccaccgatgtggccgcgcgaggcatcgacgtttccggtgtggaactcgtagtgcaggtcgaaccgccggaagatccgaaatccttcctgcatcgttccggacgaaccgcgcgagccggtcattccggtgacgtggtgaccatcattctgccgaaccagcgccgcagaacccgtcgcatgatgcgtgaggccgggctgacggtcgaaccgatcgacgtgacccctgattcgccggaagtgttggaactcgttggcgaagtggccgagccggtgttcggctggacgcttgagcagtcgcagccggcaggaaatccgcgccgtaggaagaatggcaaggggggtgccgacggcgaacgttccggcaggccgaaccgttccggcggacgtaacaaggatcgcggcaaagacaagggtggcaagccgtttaagtccgaacgtaaggatcgtcgcgatcgcgaccagcgtgaggagcgtaacgacagcgcgaagaagttcgagccgaagaagaaccgtgcggaacgtcgtgccgccaagttcgaaggtcgtgacaatcgtgaattcgaagctcgtgaacatcgttgggaacatcctgaaattcaggaggaacgccgcgaacagcacgaggaaaagcgcaacaacaaacgtcgtgaaaagtacacgcgcctgcatgagcagcagcgcagcgacaatgaacagcgcgaaacaacgaacaagcgtaggaacgacggcgattacggcaataccgacaatcgcaggaagccgggaaagaagaagtccggacagcttgcgaaaaagcagggtgcgccaagcaagaagcagcgtaagtctgaagcccgtgccgagcgtcgatatgacgacgatcgtcggtccaaaggcaagaagcatgacgagcgttcctcggatgcgaaacgctatgaccgtcatacggaagtcaagcgtggcggccgtggcgaacgtcacgacaagcatgcagggcagtcacggcatcgccatgcgaacatcaggaaagcgccattccgtatgcgttgatcgctgaaaagcaaaatcaaagcttgcgtagctggtaaacaatagaaaacggtgtccgccaaagtatatgaacacttggcggacaccgttttctattaaatctgattatctattaatttgcttggctatatgaaaagttgctcagcctgtaatcggattgtattggtcgtctgcagtgaagcacttacggtacgccatcaccataatgagactgtcagccagaagcgtcaacgctgcgatggcggcgagaatcaggaactggtatttcgccgcatcgataggattgccgccggcgatgatctgaccggccatcatgccaggcaccgtcacaatgccgctggaagccagcgaggcggtagtcggcagcaaacccaaacgaatcgacgagacgatggacgggcgcgcggcctcccaagcggtcgcacccaacgccagcagcgtatccacttcgtcacggcgttccttcatgctttcgaagaaccggttcaatccaaccgccaaagcggacacggtattgccaagcagcatgccggtcaacggtaccaccaattgcggcgcataccacggttgcgggcgaatgatcaattcagtgaccaacgaaatcataatgagcatggtgatgaccaagctcaaaaacacggggccggccaagccttttggtacacccttggcacgagacagggtgatttgcacggccgcgatcagcatgaacatcaccagcagcagcaccagccatggattgttcgacttgatgacgaactccataatgaaacccatggcgcacaattgcagtaacgcgcggcacgccgaccatagcagtgtcttgccaatgcccatgcgcatcgcttcggaaatgcccgcggctacggcaaccataaccaatgcgataagcagaccccaaatatcaatggaatagtaattgccgctcatgcctgcgctccttgcatcgaatcggactgtgccgcgaaatcattggaatcattggttgctgtggttcgcggagcattcgcactctgcaatacgccattggccagtgtaagaatacgcgtggcacgcccatccggtggacggtggcgaatacggatcaccgtcatgccccgctctgcggcctgagccatgatggacgccaccttatcggcgttctcatcatccaaaccggcatcaacctcgtcggcaagcagcacttttggcgaagtaagcaaggtgcgcgccaaactcacgcgggcggcctggcctccagacaagtcatgcggagcacgccccaagtcaatatccgcgcagccaatggcgtcaagcgtggctcgaatgcgagcatccggcagtagatcggcgggtttgagagacttgccggacgaccatttcctgccgaatccttgcttgccttcgcccgcacgaatagccagtgtgaacggtaaacgaatcgcctcggccacactcgaaccgatcaatactggcttctgcggcaaatacgccacctgactacgccactgctgcggtgtgaattcgctggcagagcgcccttcaagctgaaaatcgccgttcgcattcggattcaatcgtgcgaaagcggtaagcagactactcttgcccgatccggaagggccgaccaaatccacaatctcgccaagcttcatatcaacggataatccgctgaaaatcgtgcgttgctcaccatcgacaggcacgacacaggaaacattcgaagccgaaaaaacatactgcataatccaacaccatatcgcttgactgccggtcggaagcattggatgcgtttcgtagtgtcttcttagctggaatcacattgcatgggatattgcgtctgctgtacaaggaacatgtacagggaacatgcgcaaggaagcgcgatcggaggaaaccgtgccgcagtcagagtatcaaaccgatccggcatgactgatgcttcccaatgcgctgttggtcgaaggcgatcccgacgtggggtccgttccatgcgtatggcgggtattggaacgtgcgttcaaggcatgatcgatgatcggcaaaggtaagacgctgcctaagagcatcatccattcagcttgctcacagtatttttcgtcgatattccaaggaaaatcagcctcaaggatgaggtcgtgccaacgtttcatggactacaactggcacattggacatgaagaatatgaaagcaagaagtgagcatgcgtgcatggttgatgaacataagtttggtggatggctggtttccggcaacgttgttttcagtaaccgcagtgctggcggcgatactgctgggtactgcaatatgggagacggttgccggaagtcgtgacggtggcaaacgcacgtttgccgtagtcgtgtgtccggtagtgattgcgattattgcaggcattgccggattggtgattgcctggttgctgtcggacgtgtttgtggtgttcggtgttgagctggggccgcatgtggtcgcatgggccggttgcggttgcgcgatcattggattcgcgatttgctatgcggtgcagcataggggagtgttgcgtgccgtcgccgttgtattgacggtattcgcggtgctttccgccgccaccggcatcgatcaggcgtatggagaatatgccaccatcggatcactgttcggccaagacacctatcgtgaagccgacctgacgggaatggcgaaacgcagcgatttgattagcgtcacgcaatggaagcaggaaaaagcagacggtagcgtcagcaatattcccgcacatggcgaagtcaggaaagtaaatattccagccacagcatcgcatttcgaagcgcgaaaggcgctggtatatctgccgcctgcagcgcttgccacagccaaacacaagccggcgttgccggtcatactgatgatgagcggccagccgggctctccgggtcgcgtgtttgccgcgggcggcattcaaaccatgatggacgattacgcgcagcatcatggcggactcgcacccattgttattgcggccgaccagttgggagacgattcgcataacaccctatgcgtggattcgccggtgtacggcaatgcgttgacctacttgacgaaagacgtggtcgactgggtgaaagccaatcttccggcggcacagcaagcgcaggactgggcgatcgcaggtttttcacagggggccacatgttcgctgcagatcggtgcgaaccatccggatttgttcggtaccatcattcccaccggcagcgagctcaaaccgaccaatggcagtgaaagcagtatgatcagccggttcttccacggcgatcgcaccgcatacgagaagcagatccccatcaacgccattcgcaaccatgcaccttcgaaccagacgcttgttatcggcgcaggggagcgtgatcgcgagtccgtgcgcaatgtcgaacgcatcgcaccggttgctcaacaggcgggcatgcatgttacggcagtcgaatcgcttgacaatgcgcatgactggcatgccgtgcaagacacgttgcggtacggacttgccgtattcggctacaacacgggactgagcgatgccaagccgaaattggtcgactatccgaatctcaaacgcatttcaatctgaatcatcgaacggaagtactgtattatgacgcaatcgcaggaatcaacagtgaaaccattatttggctttcgtgcgcttatggccgatcttgccgactggattcgtgagcatcgcatgaccttggggtttgtgctgttcatcacgctgttcaatgtcggcatgcagctcgtatgcggcattagacatacgcaatttccgccgcaattgtcgcgcgtgagttttgacgcgctcgcgcatgggcgctggtataccgcgccgatttcactgctgtcggtgcctcagttgggtcgtctgctgatcgacattccactgatactcatcgcattcggcttatgcgaaacggtgattggaaaggcgaagacggcatgggtgtcgctgatcaccacgcttggcggcatagcgctcggtatgggattatgctcgctgttcgcaggcaaaagtccgcaatggcatgcgatttcgcatgatggtgcgattttggggccgctggttgttgtggtgggcacgctgatgtgtgccagcgcgttcaccgccatgctgtggcgtcggcgtattcgtgtgatcggctatagcgtggtgctgatcctgttcctgtatcgtggtgaagccggcgattactgtttgctggcgtcggcgttgcttggccatgtgcttggctatttgatggcttccgagagtcaaggtgatgtgtataggcatggtgccttgtacgagatgcgcaggctgattggtatggctgccggcgtacaggcggtcggttcgctggttgccgtttcctcaagacaatcattcggattgctctccatgttcggcttgctgacaggttccacggaattcgacacggaacaagtgttggattgcctcaacggttcctcgcatgccaactgtttcgcgcaatatcgtatgatgcgattcaccatgcccggaaactggctggtgtcgttgatgccgacgctgatgctgctgttgatcgcatggggtctgtatcgcggacgccgtattgccgcagcgttgagcgtgctgttcaatgcgtgcacagtggtgcttgcgatgctgttttatgtggtgcttccgctgcaatatgttggcgattcgcaggctgatgcgttgcctgcgttggctcgtcatggtgcgtttcatgcgatgttttccactatggcattgccgttgatttttatcgttatcgtcattgcgttccgtcagtgttttacgattcgcactagaagtgagattatgttgcgtgctgcggcaggtgcattgtcggcttttctgttgttgggattgatgtatgccggatatgggcttgcctctcccgacgatttcaatgaaagtccgcaattgatcgcattgcttgccgattatgtgcagcgattgctaccaattggtctgctgagtggtatcgaacctgagtttgtacccgtcggtcaaatctccttgctggtatatcagtgcgtcggtccggtgttttggattatcgctctgctgtgtgtttgggattgtttgcgggatcgttccatggtgaatgacgctttgcaccatcgtgttgacgcgattattccgcttggcggcgaatccatgtcattcatggcaacttggaaaggcaatgactattggttttccgcaaccggacgttccgcgatcgcctatcgagtgtcgtacggcatcgcattgacggtgacaggaccattcggagatcccagcgaatatgcggaagatctcactgatttcgcaacattctgcacacaacattcctggacgcccgtgttttacagtgtgcacgaatcgcagcgagccgaactcaccaaagccggatgggattcgcttgacgtcggtacggaaatggtcgtcaatcccaacgaatggcagacccgaggcaagaaatggcaggacgtgcgcaccgccatcaacaaagccaaacgagacggcatcaccgacgtgctcaccactttcaaggaggcacccttctcagtacaaacgcagattcgtgagatctccgcacagtgggccggcaaaaaggccctgccggaaatgggattcaccttgggaggcgtcgacgaactgatcgactcccgggtgcgcctactctacgcggttgacggcaatggcaaagtccttggcgtaaccagctggctgcccacctatcgtgacggtacgatcatcggttggacgcttgacttcatgaggcatcgcaccgacagcgtcaacggcatcatggaattcctgattgcacgcatggctgaacgactacgcgacgaaggcaacgtggaattcatgagcttatcggcggcgccgctggccggtatgggatccaacgaaagcgaacacgaggaaagcgaagtgttgcgtcatgcactgcaaatggtcgcagacatcatggaaccagcatacggattccactcactattccgtttcaaactgaaattccaccccgatgaagagaaagtgtatatctgctatcccgacgcagccaaactaccgcaaatatcgcttgccgtggcacaagcctacgtgccgtcgctcacacctgccgaagccatgcgattcgtacgtacgattgcgccgcgtgattgacatgatgtcagacttgagacggtccacggttctggggtagctcgggtctacactaaagaacggttcataaagtactacttttcctgatggaaggggccagcatgtcagctgaagcaaacgtcggcgtagtcggtcttgccgcaatgggcggtagcctcgcacgtaacctcgcacaccacggcaacaaggtggcagtgttcaaccgctcttacggccgtaccgaaaagctcatgaacgaacacggcaacgaaggcgaattcttcccggcaaaaaccctcgaagagttcgtagacagcctcgtcaagccgcgtaccgccatcatcatggtcaaggcgggagagccgaccgacgccatgatcaacgcgctcgccgacctgatggagccgggcgacatcatcgtcgacgcaggcaacgcctacttcccggacaccattcgccgcgagaaggaaatcagcgcttgcggactgcatttcgtcggatgcggtgtgtccggcggtgaggaaggcgctctgcttggaccttccatgatgccgggtggctccgaagaatcctggaagacgctgaagccgatttttgaatccatcgcggccaaggccgaaggcgaaccgtgcgtcacccatatcggtctcaatggtgctggccacttcgtcaagatggtgcacaacggtattgagtactccgacatgcagctcatcgctgaaagctacgatctgatgcgtcgtggccttggcatgactccggctgagatcggtgacgtgttcgaagagtggaacaagaccgaactcgactcctatctgatcgaaatcaccgccgaagtgctgcatcaggccgacaagaagaccggtaagccgctggttgacgtgatcgtcgaccatgctggcatgaagggcaccggcacgtggaccgtgcagaccgcactgtctctggccgtaccggtcaccggcatcgccgaagccgtgttcgcccgtggtctttcctccgaagctgatctgcgtgaggaagccgccaagcagggcttcaatggccctgacggcaacctgaacctcaccgacgatgagaagaaggccttcatcgaagacattcgtcaggcactctacgcttccaagatcgtcgcctacgcccagggcttcaacgagattaccactgctgccgaagaatatggctgggatatcgatctggctgccgtggcacgcatctggcgtggcggctgcatcatccgtgcgaagttcctcaaccgtatttccgaagcgttcgaatcaggtgaagccaacgtgtcgctgctgttcgctccgtacttcaagaacgccatcgaaaccgccgaaaagtcttggcgtaacgtggtggctcaggccgccgtcaacggtttgcctactccggcgttcgcttcctcgctgtcgtacttcgacggactgcgttccaagcgcctgcccgccgccctgatccagggtcagcgcgactatttcggcgctcacacctaccagcgtgtggatcagccgggcgcattccacacgctgtgggccgagccgggccgcgaggaaatcgaagcctgatagacgtatttctgcaacgaatctagcggattaacagatgaaaagagcctcacgctttatgaaaagtgtgcggctctttgtgttgcggcaaatatgatcagccgcaagggaaactcgttgagttgcctcctgaattattcgcgatgctggttgcgtgggttgccgccattcatgattgcggcgacccgtcgcgtcagagcgcgggggagtagtcgttccgctgcggctccggctttggtgaggtagccgtggtaggcaagcgtgcgcccctgcttcatcttccgatacgcgtaggtggcaagctggtaggcggtggccggtttggtcagcgtgaagaaattcatgccacgcatgttcgcggccttggcgaaccctgtggatgtcggcccggggcatacgcaggtcacactcacaccggtatctcgcaattcgtacgacaccgcttccgaaagcgatcgtacgaacgctttcgacgcgaaatatatcgccatatatgggcctgccatcattgaagcaacagaagagatgttcaatatgcgtccgtgaccctgctcgcgcatatcacgaccataacggtacgtaagttcagccaacgcggccatgttgagctgcatcatctcatgctggcgatgccagtcggcgtcgagaaaacccgtccaatccgcaaaaccggcgttattgacgagatgatccacttcaaaaccttgcgaaactgtgtaatcatgcaactgttgcggtgcgtcagactcgcttagatcaagcgcaaccgtctccacatgcacgccatagcgatgttccagcgtgcgcttcacgtcatcaagtttgccttgactgcgtgccgtaatgatgagatcatgcctgtcggccgcaaacaatgccgccatctcacgcccaatgccactcgaagcccccgttatcaacgcatatgccataaaaccacctttcttaagtattgatgttcatggtagtcaatacgcatgcaataacgccatttgcaacgcaatggtccggaacttttcgactgggctggctgattgacagttttcatgcacttctcgcatggaaagtaatacatcatttacattagttattttggtttggttcgttcacaatgggtgcgtcagcatgaatgtgaaagaaccagtatggaatgtccgaaaggccatgtttttgaactcatacaacagggctgcccgaccgacaaagtcattacaatgcatgtcgtgaaaccgggatcattcacagcttgcatttgacttcgtccacttgaagttcttaagtttgatggcatgacttacgatttcgacactcccgtagaccgatccggcacgtattcgctcaagtgggaagaggcaggagatgcgttgcccatgtgggtggcggatatggaatttcaaaccgctccacagattcgagccgcactgcaacagcgtcttgaccacggtattttcggatattccatcgtccctcctgcatggaatcaggcatacgttgactggtggcaccgtaggcataatcttgatatcgacccggaatcgctcgtattcagcaccggcgtggtgccggcaatctccagcatggtacgaaaactcaccacagcaaacgaaaacgtgcttatccaaactccggtctacaacattttcttcaattcgattatcaataatggatgccgcgtgcttgaatcaccgttggaatacgacggttccggacattactccatcaactgggccgatctggaatccaagttggccgatccgcaaaccacgctgatgatcctgtgcaatccacacaatcccgtaggccgaatctgggatcgcgacaccctcgcacgcataggtgagctttgctggaaccatcatgtgaccgtaatcagcgacgaaattcattgtgatcttaccgatccgggatatgattacgtgccctttgcctcggtgaatgagcagtgcgcaatgaactccgtgacctgcatggcaccgaccaaaacgttcaatatcgccggtcttaacacggctgccgtaatgattccaaatcccgtgctgaggcataaggtatggcgtgcgctcaacacggacgaagtggccgaaccgaacgccttcgccatgacggccacgctcgctgccttcaacgagagcgagccttggcttgaggaattgcgcgcatacttgacaggcaacaaagccgaagcacgagccatgatcaacgaatacaatgctgccgcggcaccggaacgacgcatcgccctgattgaaagccatgccacctacttgttgtgggtcgattgttcgaaactgacgcacgataccgctctgttgtgcgaacatctcaagcgcaatcatcaggtgatgttctccgaaggtgccgagtatggcggcaacgggcatgatttcattcgcatcaacgtggcttgcccgcgaagcaccatgcaagaaggattcaatcgtctgttcgccgggttgcatgatttttcggcagagtaatacattgatcatcgattgtgatattgctcacagccgctaaaaaacggctggttttgtgggttttcacaaaatatggaaaggacgttttcggatggtcactgccgtccgtgacgtgttggcgatactatgaagcacatgactgaaactgtttcatccgtacttggcacgcctgaagagtggacgaatccgctgcgcgatccgcgcgatcttcgacttccacgtattgcaggcccgtgcagtattgtgattttcggcgtgaccggcgatctgtcacgcaagaagctgcttcccgccatttatgatctggctaatcgtggcctattgccgccaagcttcggtttgacgggttttgcacgtcgtgattggaccgaggatcatttcaaggatttcgtgaaggagaacgtgcaggcgcactgccgcacgccattcaaggaggcgacctggacgcagctcgccgacggcattcgttttgtgcagggcacgttcgatgatccgaaggcgttcgaacgattgtcgaacactgttgccgagcttgaccgtgatcgtggcacacgaggcaaccatgcgttctacatgtcggtgccgccgcgcgcgttcccgcaggtttcccgacagttggccgattgcggtctggcgaaatcgtcggaaggtgcttggcgtcgtgtgatcatcgagaaaccgttcgggcatgatctggccagcgctaaggagctggatcgtgtggtttccgaggtgttcgacccatcgagtgtgttccgtatcgatcattatctcggtaaggagacggtgcagaatattctggcgcttcgtttcgcgaacgccatgtatgagccgatttggaacaataattacgtcgaccatgtgcagattacccacgccgaggatatcggcgtggccggtcgtgccggatactatgacggcatcggtgccgcacgcgacatcatccagaaccacctgctgcagctcatggcattgacggccatggaggagccggtctccttctccgccgctgatctgacggctgaaaagacgaaggtgctgtccgcagtgcgcttgccgaaggatctggcggcgcatacggcccgcggacagtatgccgccggatggcagggttctcatgaggttgtcggctatttggatgagaagggcattaatccggcttcaaccacagagacttacgcagcgatccgactggatgtcgatacgcgccgttgggccggcgtgccgttctacctgcgtacgggcaaacgtttgggcaagcgtgtcacggagattgccgtggtgttcaagcgtgccccgcatctgccgttcgagtcgaccgcgacgaaggagctcggcaagaatgcgatcgtgatccgcgtgcagcccgatgagggtgtgaccatgcggttcggcgcgaaggtgccgggtggcacgtcgatggaggtccgtgacgtgtcgatggacttcggttacggccgttcgttcaccgaatcgtctccggaagcctatgaacgtctgattcttgacgtattgctgggcgatccgccactgttcccaaccacacgcgaagtggaattgagctggcagatcctcgatccgatcgaagagttctggtccacgcttggccagccgcagccgtatcgttccggaacgtggggccctcaggaagccgttgaaatgctggcccgcgatggacaccgttggaggatgccgtgatcattaccatgaagaacaccgaaacccgtgagatttcggcgaaaatcgatgaattgcacgaggagcgtggcgaagcggctctgggtcgcgtgctcacactgctgatctccacgaatgagacgtcgctggagcatgatctcgccgtggcgaacaacgccagccgtgagcatccctgccgtgtgatcgcaatcgcgccgaattcacgtagggtggatgccgctgccgatgatggcaagccgcacacctttctcgacgcggaagtgcgattcggttccgacgctggcgcgggcgaaatcatcgtgttgcgtccgattggtgggctggttcaccaccctgatacattggtgattccgctattggtgccggacgctccggtggtggcttggtggccgaacgaagctccggcgaatctgtcaaacgatttgctgggttccatggcgcgcagccgtatcaccgatgccatgcattcctcgaatccgatgcggaccatggatgatctgcgccgcaactggtcgtcgaagaatgtggacatgtcgtggactcgcttgactgtttggcgcgcaatgctcgcttcgatgcttgaccagccgccgcatcttccagtaagcggcgtgcgtgtgaccggaccaaagaacttcctgccgttgaatctgctggccgcatggcttcgtcttcgtctgaacgtgcctgttgtggtggaagacgatccgaatgcaaccgccgtgaccggcgtgtatctgacccgttccgatggcgtgctgagtttggaacgcccatccaccgacgatggcatcgccgtattgaacgttccagggcagtccccgcaaaccatgagcgttcccgcacgaaccatcgaggaatgcttgagtgaggaattgggtcgactctatccggacgagatctatgcggaagtcgtgactcaaggctgggatcttatcaattcgaagcactgaatcgattctccgaaacaataaaggaacaatgcaggaaaagcatatggcagaacgcaccaccgttgtatatcccaatcctcagattctggctgaagccgtggccgcacgtacgctgttgaccatcaccgatcttctgtcggaaccgaatcgcactcgcgttgacattgccgtgaccggtggaaccgacggcaatcgagtgttcgacgccatgaacgcgagcccattgaacgatgccgtggactggagccgcgtgcacgtatggtggggcgacgaacgattcgtggccgccgatgacgatgatcgcaacgccaagcaggcgcgtgaggcatggtatggcaaactggttgccgacggccgtatgccggcaggcaacattcatgcgatgccgtccgatgagcgtaacttggaaagcgtcgcggcagcctcacccgaacagactgatgctgtgctggctgaagccgccgcgcaataccagcgtgaactcattgaacagttgggtgagaatccagctttggacatcgccatgttcggtatgggaccggacgcgcatttcgcatccctgttccccgaccatggcgagtcggagatcgacgatccgcatgtgcttgtcgccggtgtgcgcgattcaccgaagccgccgccactgcgcctgacgctgaccgtgccgatgatcgcacgatcgaagcacacgtgggtgttcacatctgaagtacgcaaggcggatgcggttgctgcagcattcgcgcaacgcaacaatccgcatgcgccaagctcttatgccgatggtgaggaactgctgtggcttatcgacaaaggtgccgcctccagattgtgatgcaagaaccgggactatggaatcccgatagccgggttccgttggttccgtgacgggcacgtcacctaagtctctgcctgtcatggattactcccatggctaaacatcaaggctgaatcgtttggatgagtgagcgcgcaacgccatgcgtgtagtatggcggcagtcaaacatgacagaccctgcattatgactatgagaggaaacggcatcatggaacagccatctaagttccaacatcagcttcagcccgatatgccatcgtcttccacgatgtccacgtcacctcatccggaacaaactccgccatggggcgcgctatgggtgttggctttgggactggccatgattgtgctggacagctcaatcgtcaacgtctccatccccaccattatcgacgatatcggcatcgacctgaccgacgcccagtgggtcacatcactgtacaacatcgtactcgccgcgctgctgcttcccttcggcaagcttggcgacgccaaaggacgcaaactggtattccaaattggaactgtgattttcgtggcaagttcattgctcgccgccacatcgcaggacgctggcatgctgctcaccgctcgcgcgttgcagggcatcggtggcgcgatgatcatgccgaacaccctgtccacggtgtccgccacgttccgtggcaagtatcgcgctgcggctttcggagtctggggcgcggtaatgagttcagccgccgctctcggaccgttgctcggcggcgtgcttaccgagaccttggggtggcgatggattttcctggtgaaccttccgctaggcatcatcatttttgtggcaaccattcctttggtgccaaagaccggtggccatacctcgaacatcacttcctcaaccgcttcttctaccattcgattccaaagcattgatgtggacattccaggcgtggtgctgtccgcactgacttctgccctgctcgtattcggacttatcgaaggcgagacctacggctggtggaagcagacttccactcagttgaagatgggtggtctgacatggaaccacggctggctgtcgccggtgccgatttgtctggtcgccggtatgctcctgctggtcgtcttcataaccgtagaacttgcacgaggcaaagccgggcgaccggtgatgctggacatgaccctgttccgcatcaagacattctcgtggggcaatctgtcggctgcggccatcgccgccggcgagttcgcgctggtgttcgcgcttccgctgtatctcatcaacgcgcgcggactcgacacgctacaggccggtgcgatgctggccgtgatgggattgggctctattatcgccggtagtcaggcacatatgctggcctccaaattcactccggtcggcgtggtccaacttggcttggtgattgagatcatcgcggtagccgtgattgcagtcctcatgccggtggaattcgcagtgtggtggcagcttcttcctttgaccgcctacggctgcggcttagggctcgcttccgcgcagctgaccagcgtggtgctgtccgaagtgccgattccccagtccggtgaaggatcggccacccagtccaccgtccgtcagcttggcaccgccatgggctcggccatctcaggcgcggcattgaccatggccatcaatgggacgttgccggcacgacttgaatcccttggactgcccgctaaagtcggcgatggactggccaaggcggtcagcagctcggctggcggtgtaattggctcgttccgcagcggagatggatcggcggcccaattcggtgacgaagcgccgaaaatcgccgatgcgatgacttccgggttcattgagggcaaccgttggacacttttggtggcaggctgcatgctgctcatcggtttgctggcttcggtcgctgtgcgacgcgcggcatcaacgcatagcacacactgacaaacatgaggcagggacgatctgctgaatggttttggtgggccagcagctcaacggcgaaaagttctactgaagccggccgataccaaggcgaaactgatcgcgcggtaaggtggggttatgaaagtagtagtgcaacgagtgagccaagccagcgttgacgttgtcaacgaactgggcaccatcgaccccaccttcgaaccgcagcagatcggaccgggcttcatgctgctggtcggcgtgagtgatgaggatggtgaggagcagatttcttggcttgcccacaaaatcctcaacctgcgggttttcgaagacgagcaaggcaaaatgaaccgttccatcaaagacatcggcggtgaaatcctgtccatttcacagttcacgttgtttgccgacgtgaggaaaggcaaccgtccaagcttcgtcaaagcgggcaagccggaacatgccaacattacttggatcaaattcaacgaagcgctgcgatccggcggtgtgccagtacgcgaaggccgctttggaacgcacatgcgcgtcggcctgatcaacgatggtccggtcaccatcaccatcgacaccgacaatctgtgatcagtatttgattacaacaccgattgttgggtgatataaaacaattgagggtctgcaagttaaattgcagaccctcaactattataaatactttttgatcgacggtgacgtttacttgttttcggtaattatcgtcaccttgttcggatcaatcttcgttgggtcaagagtcaattccttgatgacatccgcacgaatcgtgccggacgaaggattgaatacactatcgatagtgctgtgaatatcggcatccacattcgaatattcgaaagcaagcgtcgtattgattagacggcaattacgtaatacgagattatccacatagcacaaaccctgcagactttcgatcgtacagttctcaaacgtgacattacgggaattccaagccaaatactcgccggaaatgaatgaatcacgtactgtcacattctcgcaattccagaagcaatccttggaaatcaatcgagaatttgtgatttcaatattacgtgcgccatcaaatggataattgccaaccaaacgcagattataggctttaatatcggaacaattcatcgccagataatcgccacgagcgctcacattttccagtgaaacgttcgaacaagcccataatgtttcctcggcattgacgaaatcaacattcctcaacgcaacatcatggcaccggcggaaattcttcggcgcttcaaacgtgcaatcctcaacacgaatggtattcgtataccacacgcccgcgcgtgccatctcgaaccatgtgcaatcctttgccaaaatatccgagcaataccacagcggatacttccatttgaacgaactcgacttaagctcaatatcatgcgcatgcttcaacggtgattcgccatcatcgaaaatcgtgtcgatatatcgcttgcctgatgcttggaattcggcgcgttcgccggtcagtaacgcctgacgaacctcgtgcatgtcactcactgataactctccttgaaaacgttctgttgccaagatagaaagttcaagtacttgaagtcaaacgcatgcccatgtttcgctggcgggcgaagcggatgagcgatggaacgcgttataagcaatgtcgatatgcgtgcgggtgtttgcgaaacatgactgtcggtaccatgaattgaacgattagacaattgggtggttacaaggcattgtggtcgcgaacgggcttgccacgtatggcagggaggaatgcggatgagccagcggaatgggggagtgaagacgcgtgcgttcaaagccgcgttccccaaagtgctgccgatttgcatcagcttcttctttctggccatgtcgtacggagtgcttatgggaacccgcgggttttcgttcctgtggccgttgtgcatgagcgcgtttatctacaccggttccatggaattcgttacggtgaatctgctggtttccgcattcaatccgttcgccacgcttatgttggcgctgatgatgggaacaaggcacctgttttacggactgtccatgctggggcgtttcaagaacatgggggtgaaaaaaccgtatttgatttacgccatgtgtgatgagacgttcgcggtcaacaacagcgcgcaaataccggcggatgttgaccgcggctggttctatttcttcgtgtcgctgctgaatcaggtttcctgggtggctggagcgacgctcggaggcattgtcggcgggcgattgacgttcgacaccaccggtttggatttcgtgatgaccgcattgtttgtggttattttcgtggatcaatggttgacaacgaaacgcaaaagccatatggcggcgttgacgggcattgtggtgccggtgatttgcatggcgctgttcggtgctgacaatttcatgatcccgtcgttgattgccatgctggtgatgttcattatgttgcgtccgtatttggatgatttgaaacctgatgatgttgggaaacgtgatgatgctgatggtggtcgaatccgctgcggatcgtaacgaagtaggggaggcgcggtcatgatcatgaccacatggcagggcgtcgtcactgtactgatggcggtgcttggcaccatcatcacccgttttctgccgttcgtgctctttcccgagtcaaagaaaccgccgcacatcatcgactatcttggcaacgtgcttccgtatgctatgaccggactgctggtggtgtattcgctgaaaaacgtcaatccttttgctggaagccacggcattcccgaagcgatcgccatcgccgcgatcgtcgtgctgcacgtatggaaacgcaacatgctgctctcgatcgccggcggcatcgtcgtgtatatggcattacttcagcttgtttttgcatgattgtctgttttgtaggattgcccaaatctgaagtgagttttatagggattttccacagttgttattgctgatatcccatatcgtgagaagaaatgcgttgatgcgattgacgcgcctactctttttctttagccaataaggagctgtgttgagcggctctggctgtatagaagagttatatctaacgagagagaacaatatgactagtgcagcaagcactgccaatgccgcggttccagcgcccggcaaactggagttcaaggatgattacacgcctgaggaagcggaacgcgtcatccgcaattcgaaggggctccctgtcggtgtgaagccgaagatggtgtggacgtggccgaaggccctgctgtgggccgtcatcgccattgtgtgcgctattggttgggctattctggcggtttcccgtggcgagcagatcagcgccatctggttcgtggttgtggcattgtgctcctacgcgatcgcttaccgtttctacgcgtattatattcagatcaagatcatgcgtaccgacgatgcgaacgcgacgccggccgagcgcgtgcatgacggcgccaacttcgaacgtgccgaccgtcgcgtgctgttcggccagcatttcgccggcatttccggtgcgggcccgcttgttggtcctattctggccgcccaaatgggttatctgccgtccgtgatgtggatcattctcggtgtgattttcgccggcgccgtgcaggatatgctcatgctgtggatctccgccaagcgtcgcggccgttccttcggtcagatggcaaccgacgaaatgggcaagttcggcggcactatcctgtcgatcttcctgatcgtgatgaccgccatcgccatggcattccttgcgctcgtggccatcaaggccatggcttcctcgccgtgggccgtgttctctattggtatgaccattccgatcgccttgatcatgggatgcttccagcgtttcctgcatcgtagcgttatcgaaaccacggtgctcggcttcgtgctgctcgtgatcgacatcatcgctggcggttggatctccagcgttccggcaatcgccgatgtgttcacgttgaacgccaaggaactggttatcgcactggtgatctactccttcgccgccgccgcgttgccgcactggctgctcgtcaccccgcgtgactacctgtccacgctgatgaagatcggcacgcttgtgctgctcgtgcttggcattctcatcgccaatccgtccgtgcagatgccagctctgactgaattcgcgtccacctccacgggaccgaccttcgcaggcgacctgttcccgttcctgttcatcaccatcgcgtgcggcgctctttccggcttccacggcgcagtgagctccggcctgaccccgaaggctgtggagaaggaaaaccagatccgcatgatcggctacggttccatgctggttgaatccttcaccgccgtgatcgcactgattgcagccatcaccatttcccagggcgtctacttctccacgaacatgtccgcctcgcagatctccaccgcttccggcgtgaccctgaccgccacttccactcctgacgagcgggctgaggccgcggtcaaggccgtggattcgatgaaggtttccgacattgaaggcaaccagatgaaggtcacttgggattctgtcgacgagaacggcaatgccaagacctatgaaggcgccgacgctttgaagcaggccgcttccgacattggcgagaacaccatcgtttcccgcaccggcggcgccaccacgttcgctatgggtatggccaacttcctcaagtcctacctcggcggtcatgactccatggccttctggtaccacttcgccatcatgttcgaagcgttgttcatcctcaccaccgttgacaacggcacccgcgtggcccgttatcagattggtgagttgctgggcaacgtgcgcaagctgaagaagttcgctgatccgacgtggaaaccgggcaacatcatcaccacactgatcgcaaccgccctgtggggtggcctgctgtgggtcggcgtgtgcgatacgaatggtggtatcaacgccatgatgcctattttcggtatttccaaccagctgcttgccgccgcatgcttcatgctggtcaccgtttgcgtggccaagcttggctataagaagtacctgtggattcctgttgttcctctcgtttgggatgtggccgtgaccttcaccgccgacttccagaagatcgtcggaccgatcagttacttcgccaccgcttccaagtatcagacgctgatcgatggtggcactttggaaggcgaagcgttggtcaacgccaaggccgcactctccaatgcgtaccttgacggcgtgctctccgtgttcttcatggtcatgatgggagtcttcctggtcgtcggcatctaccagaccgtgaagattcttgccaagggcaagttcggtgtggaaaccacgtctgaggagccgttcgtggaatccgaatggttcgcaccgtccagcctgatcgccaccaagctcgaaaagaaggtgcagcgcgaatacgcggccaagagctatgagctggcgcagaaggaacaggccgcagcctgatgcagggattcaccaccatggtcagacgaatctggtccgcattattgaaagccaaggccggattcgtctggtatgtgcgcgaattcagcggagaagcgaaatacgaccactatctggagcatttcgcaagcgaacatccctgcgaaaccccgctgaccgaacgcgaatactggcgcatgcgagaggaatacgatcgcaagcatcccaacaccagttgctgttgctgaaactaacggccatacataaacaatccccgtctttcatttcggaagacggggattgtttttcttatatttatgttgcttgcttgcgattattcctataccgaagatattcgattgcatgttccgcaatcaatatttcgcaatcaagaagcaagtcccatgctgtatttcaatgtcatcacacgaatcgcggactgcgttactttgtctgcaaaagcggaatcagccgcggccttcgcattcaaaccatccaaaacctgctgaacataatcgaaagcgccaatgcaggcaagatcaccgccggcctcaaccaatcgcacacccaaatcactcggctgaatgccacccaacgcagtggcggacaaagaatccgaagtgatgacaccttggaatccgaccgtattgcgcaaataatccgttaccaaagcgctggagaacacggcgggattattcggatcaatagcctgataggtggcaagcgacatcattaccatggaagggttcgcctccaacgtactgttgaacgcgccgatttccgcaccgtccaacgtggtggtggtatcaagaatgccgtcggcggtgaaatcggtgttgcccgtcaccgaacccaaaccaggatagtgcttgatggcgctgcctacacccgaatccgccatgccctgaatgaacgccttggcatggtcggcattgccgtccgcatcaagaccaaaatcacgatacagtgcgccgatcgggccattggaagccctatctaccgttaccgtgcccaccaccggcgccaaatcaacattgatgccggccgacttgagttgggaaccccatacggcagccgattgccgtagctggttggtcgacattgaaccctgattggtggcggaaggcatctggtcgaaaccagcgccttgaagatgctgcaccaaaccaccttcctgatcagtggtcatcaacagctgattattggccggcgcatacgattgcaatgcggatgtggctgcggcgacgccagccgttcccgaattccaattgccgatgatcaacaccgatccgacatgctggttcacaatgagatcctgtaacgaggaaggaccggatcccgcatacaggggtgccatgacgagctgaccgacgcgctctgcaagactcatggcattgactgcagccacagctctgccatgcggcgagtcgtccaccacgcttggcacgttggatttgtcaagcgcatcatgtgatgcatcggactgctgcgaattggattgctcggattggttggagccagcattcaaactcgcgctggatgaacacccagcgaacgatagcggcagtgcgatggcgcacagtgcggcagcacaacgagcgaaatgaacgtgaactctcctcatagtgtcattatctatcacatgccggtgatggcgaatacgatcgcataagaaaagaacgggtggattcgtgttcgtgaattgcgtaaacattaggctagcggcataaagccgttccgtgcctgtcgataggctattagtatgtctttttttgatatgtttggtcccatgttcgacccggaaagcggtccgaaccgctcccaagggcagcgtgccaataaatccggcaacgatgatcccatcattctcaatgtcgaaaccgatggtgataacaccgcccggtcttcggcgaacatgcctccaagaggtccgtccggtccgcgtatcacacgccagccgaaccgtccgcgcaaatcgtcgaacggcaacaagattctaatcggtgtggtgctggcgcttgccatcatcatcggcctgttctttggcttggcgcagttcatcaccgacgtcatgtggtatgcgcagcttggcttccaaagcgtgatttggacgcagttgggtaccagggtaggcctgtgggtggcgtatgcgctgctgatcgccgcggtcggattcctgtccgcgtcgctggcgatctgggctcgccccgatgctgccgatggttccacgattcgtattaacggcgacaccattgaagtgggcaagggcgtgagttcgaagagcgcacgtcgtgtggctgtggtgatttcgctgatcgttggtttgatgttcggatcgcagttcaatgcgaattggtctgaaatcctgctgatgttcaatgcgcagagtttcggcaccactgatccgcaattcggcattgacaatggtttctatgtgttcgtgttgcctggattgaagctgatcatgtcggcggtgtcgttgctgttgcttgccggcatcatcttctccatcgtcacgcatgtgatgatgggtggcatccgcatcaccatgccagtgcatggtcgtggcctgttccacatcaccaagcgtgcgcgtaggcagatcggcatttggctgatgctcaacatgttcgcatgggcgacgaatcaggtgcttggcgtgttctcccacctcacgcaggagggtagccgcatcaccggtgccacgtataccacggtcaacgccacgattcccgttaccttcatcatggctgccatcatcgccattctcggtgtgattctcggcgtgtggatcatgaagtcgcatgcgttggaaggccaggctccgattgcggtgcgtgcttccgaagcgcttaaagcgtggaaggtgccgaccgtggccatcgcatccgccattgtggtgagcttggtgcttaccgtggcatggccgatgctgctgcagcgtttccgtgtgaatccgaacgcgcaggaaatggaatctacctatatccagcgtaatatcgacgccacccgtgaagcatacggtctgaacaatgtgaagaccgaacagtatcaggccactacggaaggcgaggctggtgcgttggctgattccgcggaatcgaccgcgcagatccgactgctcgatccgcagatcgtttccccgacattcaagcagctgcagcaatccaagcagtattacacgtttgccgatactcttgccgtcgacaagtatgaggtcgacggtgtgagccaagacacggtgatcgcagcacgagaacttgaccttgacggtcttgacaatcgcaactgggtcaacgaccataccgtatacacgcacggctatggtgtggtggccgcctacggcaacaaggtgactgccgacggccagccgaagttcttcgaggcgggcatcccaacccaaggcaagctcaccgaatccgaacagtacgagccgcgtatctacttctcgccgaacgcttccgaatattcgatcgtgggtgctccggaaggcacgcagtcgtgggagttcgattacccgaccggttccgaaggcgccaccaacacgttcgatggcaatggcggcccgaagatcggcaatatcttctcccgactgctgtatgccatccgtttcggctccgaccagattctgttctctaaccgtgtgaactccgaatcacagatcctctacgatcgttccccgaaggagcgtgtggccaaggtcgcgccatacctgacgcttgacggtcgtgtgtacccggcggtcgtggatggtcgtgtcaagtggatcgtcgatggctacaccacgtctgacgcctacccgtattcgcagatgaccgatctgggcgaagcctccaaggattccaccacggaatcttcggccacggtgagtgagctggcttcgaagaacgccaactacattcgcaactccgtgaaggccaccgtcgatgcgtatgacggttccgtggacctgtacgtgtgggacgaatccgatccggtgatcaaggcatggcagaagatcttccccggccagtaccaccagttgtcggagatttccggcgatctgatgagccacctgcgttacccggaaagcctgttcaaggtgcagcgagaactgttgaccaagtaccatgtgtcgagcgccagccagttcttctccggtgaggatttctggcagactccggtcgatccgaccgaatctcaacaggctcaggaacgcgacattctgcagccgccgtactacctgacgctgcagaccggcggatccaacgagccggtgttctcgttgacgtcgtcgtatattcccgccggtgcgtcgacccgagagatcctgacgggcttcttgtccgttgattccgatgcgggcaacgaaaaaggcaagatcggcgcgaactatggcacgcttcgattgcaggagttgccgaaggattccaatgtgccaggcccaggccaggcgcagaacaacttcaatgcgtcggcagacgtgtcgaaggaactcaacctgcttgaatccggttccaccaatgtgcagcgaggcaatctgctcacactgccgctcggcggcggattggtgtacgtgcagccggtgtacgtcaagtcttccggttccaccagcttcccgctgttgaagaaggtgttggtagccttcggcgaccaggtcggattcgccgacacgttggacgaagcgcttgatcaagtgttcggcggcaactccggtgcatccgctggcgatgctgaaaacgtcgacggctcgaccagtggcaagactgatacgtccgataccaacggcgatgcctccaccgacggttcttccggaaccgatggcacggattcgtcatctggaacagactcgggcaatgacagcagttccggcaataccggtagtagctccggcacgatgagcaacggtctgaagagcgcgcttaacgacgcttctcaggcaatgaaggattccgatgcggctatgaagaagggcgattggtccgcttatggcgaagcacagaagaaacttcaggaagcgttgaacaaggcgctcgagctcgaacagtaattccctacggttttccgtacgattgctgatcacataaggcgggagactggttccatatggggaaccggtcttccgccttctgcatatgcccggtatgctcaaaaacatgatcgagtattcctaccgcatcgcgacgcaagacgacattcaagcaatcaccgacatttacaacgctgcagtcatacgaggtggatcatcggccgatataactccacgcacatacgaacagcgcaaagcatgggttgaatcgcatcatgatccgtatgcggtgttcgtcacggaaacggtagatgatgacggagagaggcggatcattggattcagcgcgctttccgttttctacgatcgcgcaggatacgacggcgtcaccgatctcgcctattatatcgatccgcaatggcagggcaggggagtcggtacatacacattcaccaaactgcttgaagaatgtcgaaagcgtaatatgcgtaaggcatgcggcattattttcgcagacaatgccggttcgatcgcactgatgaaacggttcggttttacacagtttggcctcatgccaactgccgccaccgattccaccggcaccatgcgtgacatgagttactggtatctcgacctgtaagtacaatctttgcggttatcaagacgagacaatgtgacgcaatatgaacgcgcacaaacgtatgtacgaatgaatggaacgatttcaatggcatctgatttctggttgatcgcaggacttggcaatccgggatccaaatacgaaggcacccgtcacaatatgggatttatggcggccgatctgttggccgaacgttggtcggtcaacttttccgaccataaagggcttgccatgctcggcaaaggcgtgatgaacctgtctggccgtaacgtcaaattcttcctggcaaagccgctcacctacatgaacgagtcaggtaatgcgttggcttccatcagtgcctactatcagattgaaccagaccatattgtggtgattcacgacgacatggatcttgatttcggacgtatcaaagtcaaggcaggtggctccgcaggcggccataacggcatcaaatcaattgatcgtgccttgggaacgccaaagtatgcccgagtgcgcatgggagtcggtcatgcgcaacgcggcgcccacgcccacgacaacacggtgaattgggtgctgggcggattcggtccggatcagcgcaagcagcttccggaattccttgccgacggtgccgacgcggcggaaaccatcatcttcaacggcctcgccaaggctcaggagcagttcaatggccgctgaaccggtgcaactgccgacgtcaggttcgctggctggcattctcgacgtactcgaaaccgatgaggattttcgtgcgctgatttccgacgagatcgaagtgccggaatccgacatagaccccagcatcaccgttggcgttcccgaaggattgcgtccggcgctcgctgccggggcagcgggaacacgaccggttgtgcttgtggtggcttccgggcgcgaggccgaggaaatggttgaggcgattcgttcgtggtattccggcgatccaaacgatgtggcacagcttgaagcgtgggaaaccttgccgcacgaacgtctttcgcctcgcgccgataccgtggcgagccgtatggcggtgtttcgcagactgatgcaccctcaagagggaagcaagctgtttggccccatcaggattctcgtcatgccggtgcgttccctgattcagcctgtggttgcgggcttgggggatgtggagccgctggtgttctcccaaggtgaggagttggcgctcgatgaggcgtcgcatcgactggtggagaatgcgtatactcgagtcgacttggtgatggatcgtggtgaattcgcagtgcgaggcggcattatcgacgtgtttcctccaacattgccgcatccggttcgtatcgaattcttcggtgacgaaatcgataccatcaaggaattccatgcatccgaccagcgtacgtatggcagtgacattccgatggtctgggccacgccatgccgtgagctgcagctgaccgaaaaggtgcgcgtgcgtgcgaaatccctgatcggctccattccaaacgccgaagacatgcttgaatccattgccaacgccattcctgtcgaaggcatggaatcgttgcttcccgcattggtcgatgatatggaaccggtgcagggcatgcttcccaagcgtgcgttggtgatgctgtccgatccggaaaaattgcgtcgcgctgccgacgatcttgccaaaacggctaatgaattccttgcagccagttggcatgttgctgcatccggtcatggtgccggtgctccaatcacattcgatcaggcgaatttctacgattttgaggaaacgatttcctcactggtgttctctaggcatgacgtatggaagcttacgagtttcggtgtggactccagtagggaaggccgcgttcagctcgacgccaccaatcctggagaatatcgcggagatgaggccaagacagcttccggtatcgaaggtcttcttgatgccggctatgccgtcaccgtcactgcaggagcgcaaggcactcttgttcgactcaaacgtgccatcaacgaaacgggaatcgccaacttcgactgcatcagatcgcgtgccatcgacggattcgtcgataatgccgcgaaagtcgcactgcttaccgaacgcgacctgaccggacgtacatcggccgcgggacaggcaaaaacaccgaaacgtcgccgtaaggccatcgaccttatggagctcaaagccggcgattacgtggtgcatgagcagcatggcatcggcaggttcctcgaaatgcgccagcgtaccatcggagcgggcgccaaccagaccacacgcgagtatctggtcatcgaatacgcatccagcaagcgcggcgcacctgccgacaaactgttcatccccaccgaccagcttgaccaagtcagcaaatacatcggtgccgacgctccaaaactcaacaaactgggcggatccgactgggctgccaccaaggcgaaagcacgtaagcatgtgcacgaaatcgccgaagatctggtcaaactgtattcggcacgtcaacgtatgcaggggtatgccttcagcaaagacaccccttggcagaaagaactggaagacgctttcccgtaccaagaaaccgccgatcagctgaccaccatcgacgaagtcaaatccgatatggaaaagcccgtgccgatggatcgcctgatttgcggcgacgtgggattcggcaaaaccgaaatcgccgtacgtgccgcattcaaggcggtgcaggattccaaacaggtggctgtgctggtgccgaccacattgctggtgcaacagcatttcgagacgttcaccgaacgttttgaaggttttccggtggaagtaagggcgatgagccgtttccaaaccaccaaggagatcaacgacaccatcgagggacttgaagacggttccgtcgatgtggtgatcggtacgcacaaactgctcggaccgaaggtcaaattcaaggatctgggactggtcatcatcgatgaggagcagcgtttcggcgtcgaacacaaagagacgttgaaggcgctgcgtaccaatgtggatgtgctgagtctgtcggcaacaccgattccgcgaacgctggagatggccgttacaggcattcgtgaaatgtccacgttggccacgcctccggaagaccgcttgccggtgcttacctacgttggcgcgtatgaggatgctcaggtcactgctgcggtcaggcgtgagctgttgcgcggtggccaggtgttctacgtgcacaaccgagtgcaagacatcgcttcggttgccgcgaagattcacgagctggtgccggaatcgcatgtcggcatcgcccatggcaagatgggggagaagcagcttgacggtgtgatccgagacttctggcatcgcgacattgatgtgctcgtatgcaccaccatcatcgaaaccggtcttgatatttccaatgcgaatacgttgatcgtcgatcatgccgaccgtttcggcctaagccagcttcatcagttgcgtggtcgtgtcgggcgaggccgtgagcgtgcctacgcgtacttcctatatgatccgaccaagccgatgacccagcagtcgcatgaccgactggccaccatcgcgcagaacactgcgctcggttcaggttttgacgtggcgatgaaggatcttgagctgcgtggcaccggcaatctgctgggcgacgagcagagcgggcatatcgagggtgttggtttcgatctgtatgtgcgcatggtgtccgaggccgtcgagcagtacaaggaaccggaacgtacggaatcggttgctgtcaccatcgatctgccgatcgaagcgtccattcccgtcagctacatcgattccgacaaattgcgattggaagcctaccgcaagttggcgggtgctcgtacggaagccgatcttgacgagttgcgtgatgaacttacagatcgttacggcaagcctccggtcgatttcgaggcactgttcgatgtggcgagacttcggttcaaggcaaggaagttgggcattaccgaaatcatcgggcaaggccgtaacgttcgtgtcgccaaattcgagccacgagaatccgtgcaaatgcgcatggcccgaatctacaagggcattcaataccgtccgatgactaaaacgtacctgattcccgcgccgttcgcaggttcgctgggatctggtccaatgagctctgatgaaatcgttggttggacgaaccaattgctggatgaccttgactggaagccaacgccaaggaaatagcaggtgaagttccagacgcatccgacacgatttgtgtgagcgttcacacaaatcgtgtcggataagtttgccatacgtccacaaaacgcactattctaggcaatgtcatcacaacctaacgtttataaggagtagttgtggcagtaattgaaagcgtttacgcgcgtcagattctcgattcccgcggcaacccgaccgttgaggtcgttctcgacaccgaagacggtgctcagggcctgggcctcgttccgtccggtgcttccaccggtgaagctgaggcttgggagcgtcgcgatggcgacaagtccgtgtatcagggcaagggtgttctcaatgccgtcaaggccgtgaacgaagagatcgctccgaaggtcatcggcatggatgcttccgaccagcgcgctctcgatgaggtcatgatcgagctcgacggcaccccgaacaagggtcgtctgggcgccaacgccatcctcggcgtgtccctggctgctctgtacgcctccgctgagtccgcgggccagccgctgtaccgctacatcggcggcaccaacggccacatcctgccggttccgaacatgaacatcatgaacggtggcgctcacgctgacttcgccactgacattcaggagtacatgatctccccgtacggcttcgacacctacagcgaggctctgcgtgcaggcgttgaggtctaccacaccctgaagaacgtcctgaagaaggaaggcctggccactggcctcggcgacgagggtggcttcgctccgaagatgaagtccaacaaggactccctgaactacatcatggacgccatctccgccgccggctacgagccgggcaagcagatcggcatctccctcgacgtggcttcctccgagttctacaacaaggagaccggcaagtaccacttcgaaggcgacgatcgtgaagccggctacatgctcgacttctacgagaacctcatcaacgagtacccgatcgtctccattgaggatccgttccaggaagaaggctgggaagactgggctgccatcaccgccaagctcggcgatcgtctgcagttcgtcggcgacgacctgctggtcaccaacccggcacgtctggctaagggcatcgagctcggcgccgccaactccctgctggtcaagctgaaccagatcggtaccgtcaccgagaccctcgacgccatcgagctggccaccaagaacggcttcacctccatggtttcccaccgttccggcgagactccggacaccaccatctccgacttggctgtggcaaagaacaccggccagatcaagaccggtgctccggctcgtggcgagcgtattgccaagtacaaccgcctgctcgagatcgaggaggagctcggctccaccgctcagtatgctggctacagcgctttcaaggcctgcaagaagtacatcgccaagtgagcgtaagcgcatcgaatatgcgctgatgtagagtgcccgtcgtgttcctcgtcgaacgcggcgggtattttcattgctatgagttcaaagtcacgcaagaaagcatccagaaggggcagtgctggccccatcgcgttctttgtggcggtatttatcgtggctttgggatccatccagctggcgtcgacgttccatacctatgcgctgaatatggctgaattgaatggcttgaagaagcaggaagctgcgctgatagcgcaaaagcaggaactggaaaacgacattgcgcgttgggatgacaaagcttacgttacagcgcaggcaagggatcgtctgggattcgtatttccaggagaacaggcgattcgtgtggaacatcccgaagcggtgaccggcgaaaccacagaagatgcaaaaaagacggatgaatcgcagaaaaccgtactgccttggtataaggaaatggcgtattcgttcaaacaagccgaccaatcggacgaagtgaaatcgaaatcgagggaaacgtccgaaagtacgtcaaccggtgaatcggatgcgaatggaacaagccaggaatccggtggccagcagcagacttcacaagacaacaaccaacagcaatcaggagatcagcaggagtgacacagggtatgacaatcagcgaacaggccaaaaccttggcgaagaaggttctcgaccagcctgccaccgagcatgatattgctgtggtcgagcgtcagctgggtcgttacccgcgtggcatggtggctgtcggagcacgttgcgtgtgcggcaggcctttggctgtggtcacgcgtccgctgctgccgggaggtgtgcctttccctaccacttgctatttgactggcccggaagcggtgaaagccatctcccacatcgaagccgaaggcaagatgaaggagtacaacgatcttttggctgaagatgacgatctgaaagccgcctacgagcgtgcgcacgaactgtatttggcgttccggcatgaaatcgccgttgctatggaagacagcgaagagcatatcgaaggcaccagtgccggcggcatgcctgttcgcatcaagtgtctgcacgccttgctggcgcaaacgctggtgatgggcgagggcgccaatccgatcggagacatggcattggaggcgattcgtcatgaattcgaccccaatgtatgccgttgcacggtggaaaacgaagactgaaccatattcagacagaaagaagaagcaatgaaatccgttactgttgccggcattgattgcggtacgaactcgattcgtctgaaggtctcccgagtcagcgaagacggcgtcgaagatattgttccgcgtattcttcgtgtgattcgcctcggtcaggatgttgataagacgcatcgtttcgccgatgaggcattggaacgtgcctacgccgctgcccgcgaattcgccgaggtgctgaaaaagcatccggtggatggcattcgtttcgttgccacttcggccactcgtgatgctgagaaccgtgaggaattcgaagacactatcgagcagatcctcggcgtgcgtccggaagtcattcccggtacggaagaggctgatctaagcttccttggtgccacgagcgtggttcgtcgcgacgtcgaagctccgtatttggtggttgatttgggtggcggctctacggaattggtgcttggcggcgatggcgtaagccatccgaacacgcaggtgcaggccgcgttctccatgaacattggctcggtgcgtatgaccgaacgccacttgaagaacgatccgcctaccgaagcgcagattcaagaggccattgccgacatcgacgagcatatcgatgaagcgttcaaaacggttcctgcaggcaaaacccgcactatcatcggcgtgtctggcacagtgactaccatgaccgctctggccatgggattgaccgaatacgaccattccgcggtggatggggccagctgctcgctggaagacgcttatgcggtcgataacaagttccttacgatgccgcgcgaagagcgcctgacctacaaaaccattcacccgggtcgtgttgacgtggtcggtggcggtgcactggtgtggaatcgtgtgctcgccaaagtcagcgaagcggcctatgccgaccatggtcagcatatcgactccttcatggccagcgagcacggtttgcttgatggcattgtgttggattacggcacgcgattgcttgccgaacgttaacgtggcataatgacttgggcgtcggcttattcgatgccttgccgccatggcgaaactggtatacgcaaccgacttaaaatcggtctcttcggattgcgggttcgattcccgctggcggcaccatgcgacccaatcagaatatactggttggattttgttgtatctcgcgctgagatgagcttaatgttgactcaaaatccggtgtccacatgatgaacaacgcatgacaatcgtcgtgcaaggggctagttttctctgctgtgagagtggcgaacggcgaacaatctatgcgaagcagaagatatgcgtctctatctattgactatttgacaacgaatcttgcatacagtgcggtactgtcgatgcttccgataatgctcacccagcgtgtcggctcagcgagtgttttgtcgggtgtgatgcttggtgttctatcggctgcagcacggggaagtacactgtttttaggccggttgattgagaaaatatcaacactatggctcatgcagatcagcttggcgattatcgtactgggactagtatcttttgcatggctattgcaggtttcgcctgtatttgctttgcttggcttgatgttgttcggtgttggcatttcattggtgaatttcactcttcgagggcacatcattgcaaccactgcagatagcaaggagcaagcatcattcttttcgctggcaaccttgtctgcgaacttaggagctgctattggtcctatcacagcgtcttatgtacagtgcagacttggtcttgccaactttctcatcatcatttgtctgatatatgccgtcatatccgttatcaccggaatttgttttgagcgacatgtttatctacgaacttcagatagtccttcagaggaaaaaacttcgattctttccaccatcggtacattattgagcagtcgaagaatgttgccggtattgctgattgtcgttactggcagtgtgatgaatgggcagcttttttctggcatgtcactcgtatttcatggtttttcttcagatctgctgccgagtggactgttcttcactgtggatgccattgctgggatagttttgcagttccccatcagcaggctggtggtacgcatcatggatacaggaaaaacatcaacgtattgcatgggcttaagcctagggttgtacggcatcgcttttgtgctgttcgcagcgggaacgttgatgcaatcggtatggttcatatttgctgctctgctggtatttgcatctgcggaatgcacgtacgcaccgttgacaaatgtcgccatggtggaatccggagaaaacatgcctcttgtcgacatactcaattgtcgtcttattctgacagccattggtgaatccatcggatcattttgtggcggatttttcgtgccttttctcacatcggctttccatgcaacatggatgtattggctggctttgtccattattgcagtttgtgggctttttttaatgtatccgaaaggaaatgcagataaatgaataagaaatttgacgttgtgtctcaaatactacgtaatgcagaaattgctcctaaaaaatcgccgttgaagatatgtctggatgcctcacatatgaacaactagttcaacaatcgatgaatctcaaacagaagatactctctcagtatgctattcaataatgatgacttgtcattcatagtccgatctcaggtcttctggctgcgatgacggcctaatggtcgaggtcattgtgaaatattgctggatagcacgtacgaaacaatccgttattacactggcggcattgataaccccaagtagccgactggaacggaaaaagtatgacgtcgaaagatatcaagccagtaatcgaacagcccgatacggaaattccgctgatgctctcccaagcgattatcgtcgcaggagttttggctgtgggcgaactggcttgttctccgctgtatttctcgttgttgaaggcgtcgttggcgttgattccatgggctatggaagcggtattcatggcagtggcgttcacgttcgttgtgggctttgcgctgctgtggtgcgccgaatcgttcacgctcaaaatgcgtgaacggttccgaccgttcgcatatgcgattgttggacttatcggttacggtgtgtggagcctgctggtgttctccgccaccatcaattccgtgcttgccatggtgggggagagggtgctcaccaatggccagattggtgcgattgcgttgaatggcgcagctcttggtttcgccgccttcctgttcgccaagttacttgacgttaaactcggcaatcgtaaaaccacggccattatcatgctggtggtggaagttacggccgccatcattggtttgatcattatgattctcatgttccgtgcattgtatgcagcctgagcaaggcacctgagaagcaaggcgacgattggtatgttcagtattctcgaaatgttcaagataggcgttggaccaagttcctcacatactgttggtccgatggtggcggcatgcaaatttgtcgaatcgcttgaacatacgggaacgcttggccgtgtgagccgcgtgcgtacggtactgtatggatctcttgcgttgacgggtttggggcacggtaccgatcgcgcgactgtggcaggtctggaaggtaacatgccgcaaaccgtcgatacggaccatgtgaatatcattcgtcatgaatgcgagtcgagtggggaactgctgctggctggtaagcatcgcatcgatttcgactatgcgcatgatgtggtgatggatgtgtggcatcgcttggccgcacaccctaatggcatgcgtttccaggcatttgaccagcagaacaatcttgttgacgaacaggtctggtattccatcggtggaggcttcgtacggcaaggcaatgccgaggatctgatgatcggcattcatgagcgtccgccggtcggaacgtctttcgccgatcagcagagtgattcctcacttgatgacggctcggatgtgccatatccattcacgtcatgcgacgaactcattgcattatgcgagaagcatcatatgagtatcgccgacattgtgtgggccaatgaaacggccatgcagtcggcggtgcaggttcgcagcgaaatggataacgtgtggcgggtgatgcgtcgttgcgtacagcacggatgccatacgtcgcagaccgtgttgcccggcggtttgaatgcgccccgcagggcaccgaaaatgtatgcaaggcttgcctcgaacagtgatgtgcttgcgcgagacaagaaacgcgcggatgcggtgctcgaatcgtcggatgcggcatgggtggatttgttcgctttggcggtgtcggaggaaaacgccggcggtgggcgaatcgtcaccgcaccgaccaacggtgctgcaggaatcattccggcagtgcttcactattactggcatttcgttgaccatgcgaacgaagagggtgttattaccttcctgctcactgcaggcgcggtagggtacctgtttaaacgcaatgcctccatttccggtgcggaagtcggatgccagggagaagtcggtacggcatgttcgatggctgcggccggtttgtgcgcggtgatgggcggtactccacagcaagtggagaacgctgcggaaatcggcatcgaacataatctgggactgacctgtgatcccgtgggaggtttagtacagattccatgcatcgaacgcaacgccatggctgcgaacactgccatcaacgcggttcgtatggccatgctgggagatggaacgcatatcgtgaccctcgatcaggccattaaaaccatgaaagacacgggcgaagacatgatgtccaagtataaagaaacctcaaaaggtggtttggcggtcaatgtcgttgaatgctagcggtggttggtgctagtctaggtggcattgtgcttttcaaggaggttcaccatggcatctcaaatgcccgttgtcaatgttgagttcggcgatcgcccgaccatcgaattcccgtccgagaccgctccggcaggtctgaaggttgtggagctgctcgagggcaatggcccgatggttcgccgcggcgacaccgtcaccgttaactatcacggtgtggtctggggcaaagacaccccgttcgattccagcttcgaccgtcaccagccggccagcttcggcatcggtgtcggccaggtcatcaagggttgggaccagaccgttccggggcacaacgtcggttcccgcttggtggtatccattccgccggagtatggctatggttcccgtggcgttccgcaggccggcatcggcggcgaagacactctggtgttcgtgatcgacatcatctccacccgctgaaactaagcggcatagagtaatttccaaggtcaaggaggcaacatggccgaagaaaaaacgcttctgctgacgcaggaagcttatgacaagatgaaagaagagctcgcttggcgcgaaggcgagtatcgcgacgaaatcctttccaaggtttccgcggcacgcgccgagggcgatttgagcgaaaacggcggctatcaggccgctcgtgaggctcagcgagtaaatcagggccgcatcgaggaactgaccgtcaagctgcgcaacgcgaagattctgaccgcgcccaaggccggcgaagtcggcgacggttctttggtgacgctggatgtcaacggacgtgaaatggtctacgtgcttggcacgcgtgacctgtccatcgccacggactacagcatcatcagcccggaatccccgatcggcgcagccatcaacggcgctcacgagggagacacggtgtcgtatacggctccgaacggacgtgagatttccgtgaccatcaaggaagccaagccgctcgcctgagtgatgttcgtcataagctgaatctgatattccagcgatataaatacaaggctggttcatcgaacacaacggatgaaccagccttttcgtatatttcgtcaaactgcaatcagatatgatctgaacttacggccatagctgcacgatcaccatgtagatcgccaccatatggcatgcgtaaccggcaacggtgccgcaatggaaaagctcatggaagccgaacaccttcggccatggatcgggcttacgtagcgcgtatacgatggctccggcgatatagcaggctccgcctgcggccaacagcaccacaaccgccggaccggcatatggcgaaatccagaacaatcccatgaatgccactccggaaacaccgaaaataatatacacaatcacgtatagccagcgtggggcgctgatccagatgacgtgaatgatgagcgccacggtagtgcagatccacatgcccgcgatgattgaattgcgccagaacggttcgagtgcaaaggagaccggcgtataagtgcctgcgatcagcaggaagatattcatatggtcgatgcgtcgtagcacatccgtgacgcgaggcgaccaatcgcccaaatggtagcaggcggaattgccgaacaatatcagcgaacacgtcatgaacacggcgcaggcccacttcaaaccggtaccgtgtgccaggcagatcagcacgatgccggccgccaatgccagaggagtggccacggcatgaatccagccgcgcatcgccggcttggggcgaccatgcacgtcaagacgaatcttacgttcgatctccgccggagtgatgccttctattttcgcggcacgagcttcgcccttggctatagccattttcgccttgccgtcggccttcttgcggatgttctcggccttgttgcgtgccttcacgcgaataatatcggccttggcttgaagggcctgttcgcgtgcctcggcgatgatcgctcgtttttcctcgatctctacgtctgtgggtttcgccatctgtgtgcctccactgtaagttacggaaccgtaacctacgttaccgtaactcatggatatgtcaatattgcttttcctgcaatatgcgtcgtgtcgtgcaaaacctctggtgtgatgcgtatgatggagcgcatggctgatttctcacatatcttgacgacccgtcccgatttcgatgacgaagatcgtgaatggctgcatcatctggtcgccgactggcaggtgatcgccgacctgagttttgctgatctgctgctcattctgcaaaatggcgagggcaaatacattattgccgaacagtgtcgtccatccacggtgatgagcctgagggccgacgatgtggtcggcgacgttgtcgaggaggaaatgagcgctgaattggatgccgcgatggcttccgaatcggtgttccgttccacggtgctccgcactgtgggcgagtccacggtgtgcaatgtgtatgcgccggtgcgtcataatggcaagacgctgggcttggtggtacgtgagacgaatatggccacccgggagtcgaacggacgttacgaatccgaaagcatcagcgcaggtaagcagctgtatgagatgattcctcgcggtcagttcccatatcgtaatccgattatgaaccagcgtcacaatgcgcgtgtggcggacggcttcatcgtgctcaccgtcgaaggtatcgtgcgatatgcttcgccgaatgccatcagctgcttccgacgtttgggatcggtcagcaccatgcagggggagtatctgagcgaaatcggcaccaaattgctgcgcgagaacgatcccgtgctggaaaccttgcctctggtgctcagtggcaaagccgccgtcgattccgaactcgatgccaacaagtccgcggtgtccatgcgttcgctgccgttgatggatgccaatggccgcgttggcgctgttgtgctatgtcgcgacgtgactgagcttcgccgtcgtgaaaaggaactgcagaccaaggatgcgacgatttccgaaatccaccatcgcgtcaagaacaaccttcaggcggtttccgcattgctgcgactgcaggcacgtaagaccaagtccgaagaggtcaagaaagagctgaaagaggcgcagcgtcgtgtacaaaccatcgccatggtccatgaaggcttgagccagaccgccgatgaaatcgtcgattatgacaaggtcatttccagcctgttgaagatggcggtggatttggccaccatgcgtgaccagcatatcgacatcgacttcatcggcagattcggcatgatgccggcgcaggatgccacgccgttgtcattggtgctgaccgagctgatcaccaattccgtggaacatggcttcgaaggtcgcaaagaaggtcatatcacgatttccgtgggacgcggtggcaacaacctcaatgttgtggtcgaagacgatggcacgggcttggccaatgaggagcatgatggtatggcacgttcctccggatccggtttgggaacgcagatcatcagcacgttcgtcaacaacgatttcggaggcacggtccgttgggagccccgtcgtggcggtggcacccgagtagtgctcgatatgaagctgcgtgcggcgcaggaacgataggaaagatacgaaaatgtccggttgaccaggggaagtcaaccggacattttcgttgtaagttgctatttattcgcagagcgtatgcaatgatggatctttgaaaatttcagatctgcatctgcatggcttgggagcggcgggcacgcatggcacggcgcttgagcgcacgacgttcgtcttcgctcaaaccgccccaaacaccgtaatcctgattggtgtcaagcgcgcacttcaggcacgcgtcaatcaccttgcaggtgcggcagacggccttggcctcttcgatctgctgataggcggcgcctgtattgccgaccgggaaaaacagctccggatccttgtcgcgacatgcggccttggcgcgccagtcaaaagcactgctcatataatcgccttcctcttgccatgtacggcatgtaagtccgttactcagataaccacgaatcgcgcgacttttcaagagtcttcgcgaaaagaatcccacgaatcgttaaaaaccttggaattccacgcactgaatagggcatgctttggcctgttgcatgagcacgccacgacctgggagggtatagtcgtcggctgcgaacccgtccagaattgcgccgggaatgccgagcatcagatcgttggaacgttctccgcaggggaacgccacacgagtcggacatcggtccagcagtgcggaaataggtttttccaccgcggcaatcactgtgatattgggattggccaacgcctcacgcaattcgttcgcttcaggcgcagaggaaaagggattaagcgcttcgtccgcatcatccacaatccagatggttcgcttatgcgacggtaagggtttgccgtcatccgtcaccatgccatgttcggttttgcgtgtgaaacgaatattggcgcaacccgtgtcatatagccagcgtgcgcaatgcaacagtagattggttttgccgctgccgtaggcaccgatgatggcgatattctgttggctcacgtcaagaatggcggtatacaccaatacgccatcgtcggcaagcgcaaagggaacgttatgccatgactggtttgatgggatggaaagatcggattgcgttgcatgttgcgtgagaggctcggaaaacaggggatcggggcgtttgcaggcgtggaatcgtgcggccgttccaatattgcggacaagtcggttgacatcgcgcaccgcgctgcataggaaaggtgtggtgtgttgtccgtcattgcaataggctgcaccgggaatgctgggaggaatcagcgctgcgtcacgtatgccgatcaattcgttcgactgcatttggtctgtaacccgtaagcatatgctcagcgagatattggctttcatgtcggcatggacttggcccatgggatattgcgtgcagacgatcagatgcatgccaagggaacggccaagtgacgcaagacgattcagccgttgcatatagtcgggcagacggtctcgaagcgcatggaattcatcgatgaccacaaccagtcgtgccggaggccggaccaattggtcgaatctggaaacacgttcggcgctgaccagagcctcacgacgcaccaattcctgttcaatggcattcaacgcgcgaatcgcgtggaacaaatcaagatcgcagacattgccaacggtgtggggaagatgttccaaagcgttgaatgtcgatcctcctttgaaatccaaaaacacaaaatgcagatcatcagggctgtattgcatggcgagcgacaagcaccaactgatgagcaattccgattttcccgaacccgtggtgcctgcgaccatggcatgcggtcctgatcgttgcagatccgtgcgaaacaagccatgctccgtgactcctatagggcaggatgatgtggaggaaagccatgttcgtgtgatggtgcgccaaggcagcgcgtcctcgtccagagcgtagaaccgctcgaaacacgcatggggcattgcggcgaacggcgaatggctgttttgccttgcggtctccaccacctttgcataggtggtggagacaggttcgtcatgctgctgcttctgattggaacgcaacgccatggataccagagacaacgcgctgctgatgagtccaggagcaagcatggccacatatagccattgccgttgcgcgatcattatgacaagcatgacaagttgcgacaataccggcgcggcccagctgatgagcatcagccgatcctcattgaatccattggtatgcttgcgcttggttttgctgttcatgccgtcattgtgaacagcagtggcggatggacgcaagcgagaatcagggttgtggtcggaggatatggttatccacatcctgaccacaaccctcagctttgctgttcggcgagcgtgcctacagtgccagcccgatgggtccccttagccaattcggagaacagctcgaggttcttatcctcgtccaagagcacgcttgagccgacaccatcaacgtagtagtcgggatcggtccaataaacgcttcctgaaatgccttgatccccagaagcgcttttgaacgccaaagccatgcgcatcagcgatgaggttgaagccttttcatccacggttacggagcccaacgcagcctccgcaacttttttgactttgccgaagttcagcagcgtattcttggacgcgccctttttcactatggcgttgatgacctgacgttgacgggctgcacgtccgaaatcgccttgtgcgtccgcgtaacgcatacgagaaaacgcaagtgcggtggtgccgtcggcggtatggcagccggcagtccagttcaactgggagtacggatcgcttacatcctggtcgtagcataattcgacgcctcctaaagcgtcgaccactttgaccagacccccgaattgcaccattgccacgtggttgattttttgcccggtgatgtcttcgacttcgttaaccagttgtttgccgttgtacagttgggcgacggcgttgattttcatgtaactctggtcgatttccaccaaggaatcacgcggaatggaaatcagtgaggaaggtccggatttcggtttggtgagtaccagaatggtgtctgttctgaaaccggtcacgtcgccagcgtcaccaacggtgccttcgcgttcgtcggaaccgaggatcagccagctttcgccagcggtatcggctttgttcgtcaaccaagactgtttgttgagctgtccatccacccaattccatgcggagaatatcgacagtcccaaggcgagaatcacagcaaggaaaaacgcgagaatgacccgccccatatgtcgttttctgtgggggagcacggctttcgcagtggattggaatcctgttgtgctattgccggacaaaggttgtctgggcatgttctgtcgcgttgttcgtggcatgccagtgggtatggaggaggatcctcgtacctgctgagacgcacggtgattgttcggagctgaagcaggagcaaacgatgcaggagacgatgatgccgacttacgtggtctgctggtggagtttgcggcaggacggaaactctgtggagcgctggaaccggatggagttacggatgatggttgcgctgtacgcctgctggcgtgcggggcacttgagcgcgctggctgtgcggcaggcgaaaaacttggaattgacggagagccggattgagaaggaattgtggatttgtgaggctgtgattccgtcttcttccgtcctgcagacgggatgaagctcggtggtgcgggcatggggtccttgccgccgttctcttcactcatacaaatatcctccaaaaagaaatccgttcctacaccatttacaccgtgcaggaacggattcggtgaaagcggtctagttctttgcgggaacggcacaaaccgtcgcgttgaggtaacggtcggcaagcccgatgtactgcccggtaagagcgtcatgaatggaaccatcttcagggtcgaccgtgccgccggtgttcggatcgatcagcgtgccatcggcctgcgtgatcagaccagtgaccggatcgggtgttggcgcggcttcctgggaacccgtgttgtcagtgcccgtattatccgtattgtcagtgccatccgtcgaattatcggaagaaccgtcggaattgcctgcggtattggcatccgtgttcgcgtcggattcgtcggaaccataaatcggcttgtccgcgcgcatcttctcccatagcgtctccgcctcatcggtccagaccgaacgattcgggtccgacggcgcggatactaccggaacggtctgcgaatacaggttggacagattgaaatccttgaggctcatggcaagacctgcaagcgctgcggtatcggccatgccttgcgagatatagagtgattgcaaggctgatttcgctagctggtagagctgtgcggtgtcagtaaagaggttcttgctgagcgcttcgttcatcaactgtttgatgaggtattgctgtctggttgttcgtgatgtgtcggatccgtctcccagaccatggcgggttcgtgcgtactgcgttgcctggtgtccgtccagatggtgcaggcccttggtgagttgcaggctggtgtaggggtcgtcgacgtcctgtgggatgcacaggtcgactccgcctacggcattgatcattttgaccagtcctgcgaaatccacgacgatgaagttttgaatgttcagtccggtgaggctgttcactgcattcagggtgcagcttgcggctgaagcgagatcgccgccggtctggtatgcgttcgcgaaaatcgagttgaacatcacattgtattgcgcgggaatcgtgccgttggtcgtttcgcactgcggtatgtccactagggagtcgcgcggaatggaaacgagattgattttggtgcggtccgcggaaatctgcgccaccattgtggtgtcggcctgatggttgcctaccacgtcgtcgaagttgcctccgacggactggttctcttcgccatcgcgggaatcctgcccgatgagtacgaattcgatgggtttgccggagttgggatcgatgatcgaggtgttggcgtcaagtgagccttgtccgatgatttcgaccgaatggtctttgatgatgccattcacatccagccatgttgcggccgctgcggttcccgagaacaccagcatcgccgcgatgaccgaagcgactatcgtcctcgcacgatgctgcactcgatagccaaggctgtgacgcggctttgcgtctcgcagtccattgacgttaggaagcttatcgccggctggtgatgtggtcacggtatcgccttcctgtttatacaaaagatcacgccatatctcaacgcgttctagaacataccactactctgtcatgggattatagagatgttccccgattttcacggattctgcttcaggcccccgtcgttcttggaggtaccatgtaccatatttttctcgaattatagtgattgacacggcggaaaacttgacaaaaagaaattgcatgtgtgtaatttaacacgactaaaagtgcgcatacgtatagcaggggaggacgcatgtggggcgtgatcgacgagtcctccgataatccgcttgcggaactgtggggtctgttcaaaagcgatgatgatgtttcctggcagcatagggctttatgttctcagactgatccggaagcgttctttcctgaaaagggcggatcaaccagggatgccaagcgagtgtgcgcccagtgcgaggttcgtgagcaatgcctgaaatgggccatcgagcatgatgagcgtttcggcatttggggtggcatgagcgaacgtgagcgccgtcggtataagaaggaacacaaggaacgggcataacgcacggcacaccctgtgcgtacacttgaaattatgaattctaacgccagcagcgatatccagggaattgtgaccgatctgctcaacagcaggccgtactcccatcggcaggatgccgattcatccgtggctgcggtgattaccgcgcaaagcgatctgcgttttttctcatccacttttgccgcggtgctcgcacagcgtgtgcttccaggcactattattgttgcggattgcaccaatcaggttgagcagcctatgcagatgacgtttagcgttatcccgtcgcctgccggtgtgcttacggaagttcccgaaagcaagaccatacgtgtcattctcgtaggagtgaagggtgcctcttcattcatgaatgccgtggctcgtgcaatgcaacagatcgatcttgacgaccgggtcggtgctctgtggacattgcatgacgattccaggccggccgatgagtcatgccttgaggtgttgctcgatgcttggaaaaacacgccgactgcgtctttacttggcgcgaaacagttggattggcaggcggaaagcctgcataacgtcggtttgtatgcggggcaccacaatgtcacgtctctggtggtggacggtgagccggatcaggaacagtatgatggccggcaggatgtgttggctgtgtcgctttccggcgcgctggttccattggccaccttgcgtacttggaagggtgccgatccatggttcggcacgttcgccgaatccacggacctgtgcaggcgcatctgcctgggcggtggccgtgtggtggtggtcccgcaggcgcgaatcgcccataggagggcaagatttgaaggcgtgcgttccaaaaacggccaacctgttgaagatgaggaaggccgcgtcgatccgtaccttgcggtacgcgaggcgaatacgaaatacgcgtatacggacgtgcatcgttcttggtggccgctgctgtggatctggtcgatactgaaggcgttgggactggccgtgctgtgcctgacgcgcaaacagccataccatgcctgttgcgaattggccctgccttggcgttcgttgctccacttgccgggcgcatggagggcccgtgcccgattgcgtgagcagagtagggtctccttgaaggcattggccgcattgcagacgactcgtcagcagatcggccaatggaacgatcgcaagcgtgcgtttcttgaccagcgtggcactgtgatcctcagccctcttgccaaggcgcatctgcgtaaaaggctcatgcgcaggtgggggcttgccatcgcatcggcggtgatcgcgttcgcatggatcgtcttcctatattggaatgtgcttcggagcgtattctccggcgcgtcgatatattctcaaacgttgctgccgaccgatgccagtttcagccagttggtgcatgccgccaccacgtcgtgggcgtataccgcgggaacgggaatcagcgccccgagcgcgccttggctgctggtgctcatggtggtttccgtattcacggctggccatgttgcgaccgcagtcgccgtggtgttcttcttgtccgctcctttgatggtgctgtcgttctgggctttggctggaatctttactcggtccgacacggtgcgttgcgtgatcgcgttggcatggttcgccatcgcattgtcgatgaacgtgtacagcgatgccgacgtgacgatgatgacggtcatggtgtttcttcctgcggccttcgcgttttctttccgagccgtaggcatgtaccgtacggaagatctggtcaatccgcaggcttccgtgcaggccgcggcgcttgcggcattgtgctttattcccgtcgtcgcggccgaaccgcaattgctgctgccgctgatgttgtcgttccttgtgttcctgatgcttgtacgctcccatagaacgacgctgctgctgattccgctgccggccgcttccgtatgcgcgcccacattggtcaacacggtacgtttcgcaggagcaggtacgtggcgtcagatttttggcagtgtgatattgccgtcgtctgcgcatgatgggcatccgatgatcgcaaatctttcggatattgtttcccgtgcgttcggcgttgccgtatccggcgagatttggcagtatgtggctgctgcaatgttggcattgattgtgcttcttgccgcggtatcgctgttcctgccattcgtgcttcgcgtgtcgcgtatgatgtgggtcgtggcgatcgcgggtcttgccacgtcgctgctttccgccgcggttgtggttgcggtcgatgcggatggcgccgtggccggttccgtgcttcccggcgtttcattcacgatgatgggactgctgtcttgcgtgtgcatggtcgcaggcggtgcggtgcaacgtttcgtcatgctgtggcagaggcccaccggcgatgtcgaagttgagaggaatggcgcttctactggcattattgccgggcgtgcggcacgaatcgtgctggtcatgctgattgcggcgtcggttgtggcgagtgccggttttgattatgtcgccagagaccataacacggtttcgaccagtgattccggtttgccgattgttgcttccgactatcttgcgcaggatgaggcgaggcgtgtgctcgcagtacgcgcggatagtgccggttccatcagctacaatgtgatgcgcacccgccgaggtgatttgatcgacagctctccggcacagcgtgtcgaagtggcgttcggacgttctgatgatgcgaacaaggccatcgccaaggattgcgcgcagctgttgtcgaatgctgattccgacgccgtcgccgatttgagcgagttgggattcggaggcatctatgtggtgcgctccggcgaagacaaggcgcaaaaggagataaccgatcagttgagttccaatatcagcgcttccgatggcacgcagaatgtcgtaagcactgatgcgggaacatactatcgtctcaccatccaagatacggccaagcagcatatcgaccgcaagggatatcgacaggctgaatcgagtgtgtggcgtcaggcatggctgtggtgcatgggtattgttctcgcagcgtattgcttggttgcgcttccgcgcatgaggcgtcacggtcaggaggaagcatgagcaaacattcccgttccaaaacggtttggcgtgtaattctggccatggtgtcggtgttggtcattgtcgcactggcgaccgtggccgtaatctaccgcccgacttggattcatgcggattcgccggtaacgcagcgttcatccgtatcccgcaccgtcagtccgcgtcagctggaaacatattgtccagcacgaatgacgatagctgatactgatgcgtatggagacagcgaatatcaagcgtccaacggcaatatcatgtcgtcggcgcgttatgcgtccttcggttcggtgttccgctcttccgtagggcttctcggagctgatgaagccacttcgtcattggtgttgaacaaggatgatgccggatcggatgatgatattttcatggcgtccggcacggtcgatgacggagcccaattgcagaatacccgattgctgtcggcttccgatggaacgggagcggcctcttcggtgatgtcttgggctactgagggagatttgaaaggcgtttccgctgcttcctgcgtcgctccggctttgaagcagtcgctgatggtgtcgggcaccaaaacaggcatgacccagcagctggtcgtggccaatccgtcggctaaggccacgtcggtgaacatcaaggtttggggatccgacaagtcgggtgctttggcattgtctaccggttcgacgttgacggttggcgcgggcaaggaatctgtgctgaaccttgccgcagcagcttccgggcaggatgctttgtacgttaccgtgtccagcgtggacacgcccgttgcggccgtggtgcgcaccatagccatggatggtctggttgcaaaaggatcggattatgcggttcccaatactgttgccgcaaaaacattggcgattgacggactcacggaaggcgatgccgtcaacctgtatgtgtatccgtctcggcaggccgacgtcaccgtatcttggacggatgaccaaggtctgaagaaaaccaatcagcagacgctcgaatcgaatcgcgtttcggtcatcgacctgggttcggttcccaagtcggcgaccggacttaccatcagcgccagcgagccggtatccgtcgccgcgaagatcaccaatgatggcgatgatgaccaggctgatttcgccttggtcaacgcttcagtgccgatgagcgtctccgccatggccgtgcccgaccatgccacggctcaagtgggcatcaccaacatatcgggcgatgagcgcacggcaacattgacgtcctataacagtgtcggagatactgttgaccagcgtgagattgctctccaatccggcgcttcgacaacggttgatctggcggatatcaacgatggagacgtcgccgccgtaagctttgccgatccggaccaatcaatggtgtggaacatccgtatcagccaaaaagacgtatcggatgcgaaactggccggagtgtcgattatcggcgcaacggatctgaaggaagcccgcgagcaggtgctggccaaccagaacatgaccgtcgtgcgttgatcacataccccaatcggggtcgatctcttcgggacggcgtccatacagttccgccaagcgcaacaccacttcgtcgcggatggcgaattgcaggtccatacggcttcgcgcatgcgattgcaaaggcatacggtacagcacgacgcgcggcggaatgccatgttccgcggggaaagactgcgagcccaagtgcgcagtggcctcccatggtgccgggtcggatggcggaacatcctcgaccgcaaactgtaccggtgccaccagttcgggccatgcatcgttgagcctacggatctgagccaccagcatgtcgtcgaacataccgcttcttgtacgataacgtggaagtctggtaccgaacatgggagtgcgggtcccacgaccatgacggtttctatacactgttgattcccaaggcaattgatacatggcttctaccatatcagggccttgcgcgaatcatgcgatagcatattgttcattgcatcgacacaggaggaaacgatcatgacggatatttccgtgccctgttggaacgacgtggatatcgaggaattgtgcaatggagtacgccttatcgccttcgatctcgacaacacgttggcaaggtcgaaaaagccaatgaaggacgacatggccgaatgcttctccgcattgacatcgttgattgatgtcgcggtgatcaccggtggcaagtatgcattgctgaaaagtcaggtggtggaacggttgacaggtcaagccaatcggtcgcatctgcatcttatgccgaccagtggcacccgatattaccgttggggcggatcggattgggcgccggtcttcgcccatgacctcagcgcggatgatcgtgcgaaagcttacgaatcgttggaacgcaatgcgcgcgaacagggtatctggctcacgcacgtttggggtgaacgtatcgaggatcgtggcagccagatcacattctccgcattagggcagcttgcgcccatcgaagccaaggaggcgtgggatccaaccaacgagaagaagaatcgtctggcacgagcggttgccgccgatctaccgcatttggaggtacggccgggcggcgccagcagcgtcgatatctccgaaaaaaacgtcgacaagtcgttcgctgttcgagaattggccgatattctcggcattacggtggcgcagattgtttttgtgggagaccgtatggatccggacggtaacgattatcccgcggcaaaggcaggcaccagggcggtgaaggttacctgtccgaacgataccgtgaaattgtgcggtggaatcatcgccagtctatcgcgatagaacctgttgggaggtttcgcatgaactcaatggcgagggcatgctcgatggtggttaatctgctgtttccccggggctgcgccgggtgcgacaaaccggatgaagtgctatgcgaagcttgcagggcattgttttcccagccgaccgcacagtcgtttgacggtgtggcgatgcaacgctggttcgcatgcggatggtaccgtggcacggtcagaagggcggttctcgcgtggaaggatcacggcgacgaggaatgtgaccgtgcgttcgccgatgcgatatgcgcccttgcaaaagcgtctggcgttattgacttcgttcgtgataggcatggttcatgccatgatgttgttgtggttcccgcgccttcgtctcccgcttcaatacgtcgtcgcggacgtaaacatatgatgccgatcgccaaacatctggcaggttttctatgggaggaaacaggctgcgaggtgacggtgcgtgacgcgttggagaacaggggggtcaaagggaaatcagtgcagaccagcggtgcggcgcaacggtcgcaacgtttgaaggggcgtgtttcggtgtgtccttcggtttccttgcgcaatacgatggtgattctggtagacgatattgtcacgaccggtgcgaccatgcgcagttgcgtcgaaacgatgcggaaggagggtgccacggtcgtgaccgtgcttgctttggctcacactccggcgggaacgcagaaggttggcccaacgcaagcatggtcacgcacgcaagtgcagtgacgtgagaaatcctctattcgtcatccgtaacatggtatttcggcagaatgatttcaaaatcggctccacgcgggtcatcgacgaccctcaccgaaccaccgtgcaactgggcggcccaacgtgcgatggacaatcccaagccggttccgcccgattcggtgcccggacctgtttttcctttgacgaaacgacggaaaatgtcggaacgcgcctcttgcggaatctgcgatccgaaattgacgacattggtgacgatggtgccgaaatccttgttttcgtgtgcttcgataagcaccgtggtattgtccgcggaatgcttgagcgcgttcgcgatgatattggtgaacagttggcgcaggcggtcctgatcgcctgccatctcgatatcgtcgggcacatgcatttcgatgtcatgcgcatgcccggcatcggcgatttccaaaggttccacggtttcgtcaagaaaatcggcgaaattgaacatttcgatttgcaggcttgccgcgccggcttccatgcgggaaagatcaagaaggaacgcgatcagatcggacaggcggtgcgtctgattgaggatgctttccagatttgatggcgtagggtcgatcacgccatccgccatgttttcgaccatggcttgaagcgctgatacgggcgtgcgtaattcgtggcttacgttggctaccatgtcccggcgcatctggtcggcatgctgaagctcttccgccatttcgttgaaggtgagggcgagctggccgacttcatcgcgactattggagtcgacatggacgcgcacggtgtaatcgccttccgccatcgcttcggcggcgtcgcgcatttggcgcaggggagaggtgagtcctctggagaagaaatatgtgattcctaaagccacggcgagggtaatgggcatggcgatccatacgctgagccctactttgagcaggaaccacgccatgatgaacgcaatggcggtggagatggtgatcagaacgctcaattcaattttgagcgatgagaacaaaccaataggacgttcggtttccaatggattcaccgaacgccctggttttgtatcggtagtacgcataccaccgaattttagcgcattagtcttggacttctggcggttcgaacgcgtaaccgacgccatgcacggtacgaatggtcttcgaaccgagcttatggcgcaatgccttgacgtgcgaatcgacggtgcgagtgccggaagcatccacccaatcccacacttcctcgagcagtttctcgcgagtgagcacggacttcggcttgcgggccagcgtggccagcaaatcgaattccgtaggggtcaggtgcacctgcttgccattgacggtgacgatacgttgcgcgggatcgatgaccaaggagccgaaatcgagaagcttctcgttttcggagtttttggcgatgaccttggcacgatctacacggcgcagcaacgccttgcaacgggcgatgagttcgcgcatggagaacggcttggtcatgtagtcatcggctccggcaccgaggccgatgaccttatcggcctcgtcgtctcgtgccgtcaggatcagcactggcacagggcgctccgccacgatgcgtttcgtggcctcaagaccatccatcacgggcaacatgatgtccatgatgaccagatccggacgcaacgtagtcgcggcctgaaccgcactggcgccgtcggatgccacgcgcgccgtccagccttccgctgtgatgcgctgcgcgatggcagtggccagtgtcggctcgtcttcgaccaccagaacggtgcgtggagccgttgtgggttgtgctgatgagttgagcatagctttccgcctttctcagagttccggcttcaagaatactgcgcccagtgccggaacggtgattttcgcggaccaatcacgtgaatggtattcgccttcgatcgcttcgaccgtgccattgtgaatgccggaaccgccgtagatctcatcatccgtggtcagcacttcggtccatttgccgcccttggtgagcggtacctgatagtcggtccatgcctcgccggagaagttcaccacaaccaccatttgctctccgtccttgccgatacgcacgaagctgagcgtgttgtgatcggcgtcatcgctggtgagccactggaagccggccgggtcgaagtcttggctccaaagtgcaggggaagccttgtacagcgtgttcaaatccgcgacaagcttttgcacaccctggtggtccggccattcaagcgcggcccaatccacggaaccatcatgatcccactcgccgtactgggcgatctcattgcccatgaaggtgaggttcttgcccgggtgggcccactggtaggcgaacagcgcgcggacaccggcatacttctgccaatcattgcccggcatcttgccgaacatggatcccttgccgtacacaacctcatcgtggctgatcggcagcacataatgctccgaataggcgtacaccatggagaacgtgatctcgttgtggtgccacttgcggttaatcggctcctcatgcagatactgcagggtgtcgtgcatccaacccatgttccacttgaggccgaatcccaaaccgccggcgtcggtcggcgcggtgatgcctgggtaagccgtggattcctcggcgatcatcatgatgcctggattgttcttgtatgccgtggcgttggcttccttgaggaagtcgatggcttcgagattctcgcggccgccgtagatgttcggatgccactggccggcctcacggctgtagtccaggtacagcatcgaggagaccgcgtccacacgaagcgcgtcgatatggaactcatccagccagaagcaggcgttggccaccaggaagttacggacctcgcgacgtccgaaattgaacacgtacgtgccccaatccgggtgctcgccacgagtcggatcaggatcctcatacaacggcgtgccgtcgaagcggcccagtgcgaacgcgtccttcgggaagtgggccggaacccaatccatgatcacaccgatgccggcctcgtgcaatttctcaacaagatacttgaaatcgtcggggccgcccaaacgcgaatcgatcgcgtagtagccggtcacctgataaccccaggatcctgcgaacggatgttccgccaacggcatgaactccacgtgcgtgaagccttccttctgcacgtagggaaccagcttgtcggcaagctcacggtagtcgttcacgtccttgcgccagctggaggcgttcacctcatagatgctgaccggtccgttatgcgggtcgctggccgcgcgttcggccatccaatcggcatcatcccattcatgggtggattcgaccacgatggatccggtgcgcggcggaatctcgtgggagcgctccatcggatcggccttcatggtccattcgttattggcgttgaggatttcatacttgtagatttcgccggcctcaatgcctgggatgaacagttcccaaatgccggaagaaccaagttcgcgcatggcgtgggtacgtccgttccagccattgaaatcgccgaccacgcgcacggcatgcgcgtttggcgcccatacggtgaacgcggtgccaaccacctgctcgccatctacgccttcagaagaacccatcggatcgtcatagcggagcacatgtgcgccaagtgcctcccacaggcgctcgtgacggccttcgccgaatagatacatgtccatctcgccgatggtcggcagataacgatagggatcgtcagacaccacaacggaaccgtcttcatactccgtgcgaatacggtaatctggcacgccgtacccctcttctgctgcggcggcgggaacgagtgccatgaagacgccattgtattcatggattgcgagcgtttgaccttgttcagtgataatcgtcacggattttgccaacggacgcaagactcggatcgtgacgacatccgcatgcttgccggaaccgaggtgcccgccgagcacctcgtgaggattgtagaacgtaccgttgcttactgcatccagtgtgccctggggaacaggaacagcaacgacatcttcattgatcttggattctgtagccatggcaaaagtgtaagcatgaaacggaagaaaagtggcccgtgtcgcgcctatttttccgtttttcaagtgtttttgtccaagtccacccctgatggcacaataattcgggttttgtgtaagcttttcacggaggattcatgggttacaaggtcggcgacatggtcgtctatccacgtcacggcgctgcgaaggtggaggccatcaccgaacggacagtcaagggaatcacccgcgaatatctgcagctgtcggtgctttcgtctgacggtctggtcatcaacgttcctgttgataatgccaaaaaggttggtgtgcgagatatcgtcgacgccaacgaagtggccaaggtgttcgagattctgcgcactccgatcattgagaaggagatgaactggtctcgtcgctacaagctgaatgtcgagaagatcgccaccggcgatgtcaataaaattgcggaagtggtgcgtgaccttgcgcagcgtgatgttgacgagcatggtctgtcggctggtgagaagcgcatgcttaccaaggcccgtagcattctgacttccgagatttcgctgtccgaacaccttgatgaagccgaggcccagcgtttgctggacgtgaaccttgggtatgagccggcccagcccggcgatgaggagcatcataccgaggctcccgaggaggctgccatggatacgctggcccgagttgaggccgaaagcaagaagtccaagaagaggtaaggcgtttcatgcgtatcggtcagggttttgacgctcatcgattcgcatctcacgatgcaggcaagccgttatggcttgcctgtttgcgttgggagggcgatggcatcgagggcgattcggatggcgatgtcgtcgctcatgcgttgattgacgcattgctttccgcggccggtcttggtgatatcggcaccttgttcggtgtcggctcgcagtccgatggcgcgggcaagcatggcgccgaaatgttgcggaccacggtcgattatctgaacgaacgtggtatgaagccagtgagtgccagcgtggtcgtgatcgccaatcggccgaaaatcggaaaacacagggaagaagccgaacgagcgttgtctgaagccataggttgtgaggtgtccatgaccgccaccacaacggatggcatgggattcactggttcgggcgaaggcgtcgccgcgattgccgatgctttggtggaacctgttgatccatcgactcgtcaggcagtctgatttcgcccgctgacggctttccgatacttctttctgctactttcttttgaaggattcaatagccttcgcaaccgcccaaaacaacgtcgaaattgtcacgatgatgaagctcgggggagcggggaacatggcggaaatcacgagccctccccaaatcgaaatcaggcagatcaccgtggcgacgaccatcgccttgaatggtgagcgggcgatgatgttggcggtggcggcgggggtgatcgccaacgcgaagatcagcaatgtgccgactgcgggaacggcaatggtaatgacgccggccataattgtcataaagcaaatgttcatgaaaccgacgggcacgccttttgcctgtgccacctgctcgtcaagcgaactgaacaatagcgggcggtagatcactgccagaacagccaaaagcagcacgtcgaaaatcgcgaaaccaatgatctgaccgtcggtgatcgtcagaatcgagccgaacagaatcgactgcatctgctgcgaagccgagcttgacatgcgtgcgaaaaagagaccaaggccggtggcgaaagcgagtacggttccagtggcgatctcacgctgtgaagccttcttgccaagcgcgccgatcaccagtgctccgccgagagcgaacacgccaagacctgcggaaacaggcaggccgagcaatacggctccggtggcacctggcagtccgatatgtgccaaggcgtgggctgcgaatgtggaatgtctggcgatggtgaaataacccatcacgccggctgccaatgcgatgcacaggccggcgagaaacgcgttcgtcatgaatggggcgttgagcgtggaaacccaatccgggtcgaaagcgaatacggtaccgtccatgctcagtcctcctgcgtggtgtggctgtgatggtgaaattgcgcgatttcttctggagcatgcgcatcgatgctcatgttttcagactcgtcctcgcttggcgtcacgaacatatctccttgcggagtggtgaccacctgtacggtcgtgccatataaatgcgtgagtagatgggaatccagcacctcgttcatgcctgcatagtgtggatgtccgtcaagcagatagacggctccagtgaggatgggcagaagcatattaaggtcgtgcgccaccacttggatggtcatgccgagttcgcggttgagtttggcgagtacgtgcacagtggcgcgttgactcgccagatcaaggttggcgagaggctcgtccagcatcagcagtttcgggtcatccacgagcgcctgcgcgatggcgaccctttggcgcagtccgcccgaaagttcggatagacgataattcgctttgtcttgtaactcgacgaagtccatggccttgcgggctttctcgcgaagtgttttggtgacgggatgaatgccgaatcgagttcccgtcaagccgagaagcaccgactgttccgcggtgatgttcgattcgatgtcggatgcgtagctttgcggcacgtagccgatgcgccggtttgcggagcctgcaggctgtccgagtaccttgatgctgccgtgcgcggttggaatcaatcccagctcggccttcatcatggtggttttgcccgcgccgttggtaccgacgattgcggttaccgagccttgcggaatgctgaacgtgccgtgttgccagatgacgtgaccgcctcgtttgacgcaggcgtcgtcgaattcgatgcaggcaggtgtctcgtcgtgcatggcttctccttgatttgaatgcacgtacatactcgcaaatggtgttgacaatcattctcaataaggattgtcgttgaaaccgtcgtaacgatcagacgagaggctttgcgtaaaaagcaaaacgtcaggcaaacaaaaaagaccatcccgcattcagttggacgcaggatggtcttggcaaaagcgattaccgatcgattgttcggcaatcgcttttgccgaacaatcatttcaccggatttggttgcggcgcatcgttcgatccgttcgttgtctgatcgttgtcttgcgtcgaggaatctgcggttgattccaaggaatccgcgttttccgacgtgctgtcggaacttgttgcatcctgatcgtcggcatcggattgttcatcgaacatatcggtcaacgacaggataagagcgcggatccacgatgtcaggctggtgtaatcggagggcatctgttcgctgacatcaagcacgggaacgtcggatttgtaagcaatgccggtcagcgtgttcgtggcgtcgcttgtggattgtgtgtcgttgatcagcacctcgactttatgcttttccagcaattcctgaaattcctgaagatcggtgggggttggctcggaattcgtgctggacgattgcagatacccctccggcgtgttgtcggtgaaccccatgtcgctgagcagatagtaggccaccggttcggtggcggcgtaggagacgttcttatacgagtcgctgaacgccttcatgtccttttctattttcttctcccgcctgttccacgcggtgagtttgttgttgaaatatttcttttgcgcgggcatgatgcggctatatgtgtcggccaattccttggccatggcgtttcgggcgtcactggagaaccataaatgcggattgtctccctcgacggcgcccaccatttgtgctgcggaaacggaaaccatggtcttactgaggttcttggtggcccaagtgtcatagccggcaccattggacactacgacctgtgcctgctgaagtttgtcgatatcgtcggttttcggctcgaaatcatgcgcattgacatcggttgaagagagaaccgacgtgaccttcacatggacgccaccgatctgctcggcaagagaaccccattgattgaccgaggcgaccacttcgattggagtgatctgttcggttggggtttcggagtcggcggaggcgtcattctcctgcgaagttgaccctccggaacatgctgccgtgccgaacgccacgcaaagcgcgattcccgcagcgaaagcgcgtaacaaagaacgtttgtgcaagcgcatgtcgattgccctcttcctgaaccgccctaatcgtgttcatctcataaatacgtgtgcgacttacgactgaaaccaagatagcctacgatacatgcaaatgccaatacaacaatgagacaacgaaaaggggagtggccggcatggcggtgaaaatcgatggaaagatggtgtccgcgcagatcaaagcgaatctcgccgagcgagtcgcagcgctgaaagagcagggggttaaccccggtcttggaactatcctggttggttccgatgccggatccgtcaaatatgttgccggaaagcatgccgattgcgctgaaatcggtgtgaactccattaagaaggagttgcctgccgacgcaacattcgaacaaatcgccgaagtcgtacaggagcttaacgccgatcctgcctgcaccggctacatcgtgcagttgccgttgccgaagggcatcgacgagaacgccatcatcgatctgatcgaccccaagaaagacgccgatggtatgcacccatataatcttggcgaactcgtgttgcatgcgcgcggcgagatcactactccgctgccatgcactccgcgaggcgtgatcgaactgctcaaagcctacgacattgacctggacggcaaagaggtctgcgtgctcggccgaggcatcaccatcggccgcactattggtctcatgctgactcgcaaggcggtgaatgccacggtcacgctgtgccataccggcaccaaggacgtgcgcaagcatatgcgtgaggccgatatcatcgttgcggccatgggctccgccggtttcgtcaagccggaagatatcaaggaaggcgcggtgttggtcgatgtcggtgtttctcgcgtgttcgacgaggaggtcggccgttatcgcgtgaagggcgatgtcgataaagcctgttatgagaaggccttggcatacacgccgaatccaggcggtgtaggccctatgacccgcgccatgctgctggaaaacgtggtcgagatggccgagcgtcagctgtaattgcgctctgtgtgtgaaaatatgaagtaatttcgggcgtgtcgcgggttgcggcacgccttttttgtgcatggtcccatgtaaacttacgccttgcgtgtgttatatcgcacgcacataattgaagaccgattttatccacccactatttgtaagaaaccaaattaatggcagagaacaataacgaagtcgccaaggtcgccatcaacgacatcggcaccgaagaggacttcatcaaggcagtcgattccaccatcaagaacttcgatgatggtgatctggtcgaaggtaccgtcgtcaaggtcgatcacgacgaggtcctgctcgacatcggctacaagactgagggtgtcatcccctcccgtgagctttccatcaagaaggacgttgatccggacgaagtcgtcgaggtcggcgacaccattgaggcccttgtcgtcaccaaggaagacaaggaaggccgtctgattctgtccaagaagcgtgcacagtacgagcgcgcttggggagacatcgagaagatcaaggaagccgatggcgttgtcgaaggcaccgtcatcgaagctgtcaagggtggcctcatcgtcgacatcggtctgcgtggcttcctgccggcatccttggtcgaaatgcgtcgcgtccgcgacctgtccccgtacattggccagaccatcaaggccaagatcctcgagctcgacaagaaccgcaacaatgtggtgctctcccgtcgtcagtacctcgaagagacccagtccgaagtgcgcgaaaccttcctgtcccagctcaagaagggccagattcgcgaaggcgtcgtgtcctccatcgtcaacttcggtgcattcgttgatctgggcggcgttgacggcctgatccacgtttccgagctgtcttggaagcacatcgaccacccgtccgaggttgtcaaggtcggcgacaaggttaccgtcgaggtgctcgacgttgacctcgatcgtgagcgcatctccctgtccctcaaggctacccaggaagatccgtggcagcgcttcgctcgcacccacgttcctggccagatcgtcaagggcaaggtcaccaagatcgtccagttcggtgtcttcatctccgtcgaagacggcatcgaaggcctcgtgcacatctccgagctggccaaccgccacgtggagaacccggagaccgtcgtcaagccgggcgaagaagtcttcgtcaaggtgattgacgttgatctcgatcgtcgccgcatctccctgtccctcaagcaggccaacgactccgtcgatccggcttccgaggacttcgatccggctctgtacggcatgccggcagagtacgacgagcagggcaactacaagtatccggaaggcttcgacccggcaaccaacgagtggatcgctggttacgagaagcagcgtgaggagtgggagtcccagtacgccaccgctcacgatctgtgggagcagcataaggaatttgtggccaaggagctcgagaacgctgaagcttccgccgctgaagatggccaggctccgaaggaagagaaggtcgaagaggtgtcttccaactactcctccgagaacacttccgccggcaccctcgccgactccgaccagctcgccgctctgcgcgaccagctgctcggcaagtgattgtatcctgagctaggatccaatccagctcaggctagattttagaaaagaccccgttcctgattcaggttcggggtcttttcgtatgtgcatggcaagcgcgcatgcgaagcgcattacaatggcggttgtggtgattcgaataggattgactggtggcatagcggctggcaaaagcacggtatccgcaagactgcgtgagcttggtgcagtacttgtcgattatgatctgcttgcgcgtcaagtggtggaaccaggcagcatcggccttcagcgtatagtggaatgtttcggctccgatgctttgaccgatcgaggcgagctcaatcgagcgtggatggcagagcatgtgttttccggcgctgatgcggaacgaaaacgcaagatgctggacggaatcgagcatccactgatttatgaacttgcagtgcaactcgaacatgaggctgttgaagttgattgccaagcagtagtggtgcatgacataccgttactcgccgaagtaattgacagcattccttttgaattcgaccatatcgtaactgttgaagcgcctgaacaggtgagggtcagcagaatgatgtcaacgcgaggcatgagcgaaagccaggcatggaatcgtgtgaaccatcaatccagcgtggaacagcgtcttgccattgccgatgagatcatcgattccacacagtcattggaacaaatgttcgagcatattgatatgctaatgcaacaatggcgcacggaagcgaggtaggtatgggattcaatattgaacgcacgaacaagccgtttgtggtcaaatcgccatataagccgagcggcgaccagcctaaagcgattgaagagcttgcggaacgcattgaaaacggtgagaacgatgtggtgctcatgggcgccaccggaactggcaaaactgccaccacggcatggcttattgaacgtctgcaacgcccgacgttgatcatcgaaccgaataaaacgttggcagcgcagctgtgcgccgagttccgtgaactcatgccagacaatgcggtgagctatttcgtttcgtactacgactactaccagccggaagcctatattccgcaaacagatacgtatatcgaaaaggattccaacatcaatgacgacgtggaacggcttcgccatgcggccacggcgaacctgctgacgcgtcgtgattgcgtggtcgtggcaacggtttcctgtatttacggccttggtacgccggaagaatatgccgggcgtatgctgtttctcgaggaaggccagcagatcgaccgtgacgacttgctgcgtactttcgtcgccatgcagtacaagcgcaacgatatcgccttcaccagaggtactttccgtgtgcgcggcgataccgtcgaaatcattcccgtatatgaggaactggccatccgtattgaattcttcggtgatgaaatcgaccgtatttcaaccctgcatccacttaccggagatgtgatcgggcgtcaatcgcaagtccatattttccccgcatcgcactatgtggcagggccgcaacgtatggagcgagcgttgtctaccattcagcaggaacttgatcaacgtaccgccgaactacgcaaacaaggcaaggaacttgaggcgcagcgtcttaccatgcgtaccacatacgatttggagatgctttcccaggtcggcgtatgttccggagtggaaaactactcaagacatttcgatggccgtgagccgggcacgccgccgcatacgttattggatttctttcctgacgatttcctactcgtcattgacgaatcgcatgttaccgtgccgcagatcggcgccatgtacgaaggcgatgccagtcgcaaacgcacgttggtcgaacatggcttccgtctgccttcggcgatggacaaccgaccgctcaaatggccggaattccttgagcgcgtcggccagacggtctacctttccgccactcctggcgattatgagcttggcttgagtgacggtgtggtcgaacagattattcgaccgacaggattggtcgatccgcaaatcgatgtgcgcccggttgacgggcagatcgatgatctgcttgcggagatcaaggaccgtgtgaatagaaacgagcgtgcgctcgtcaccacgctcactaagaagatggctgaggatctgacggattatcttctggagcgtggcatcaaagtcgaatacctgcactccgatgtggacaccctgcgacgtgtcgaattgctgcgcgaactgcgcgaaggcaaaatcgacgtcatcgtcggcatcaacctattgcgtgagggtcttgatttgccggaagtatcgttggttgcgatccttgacgcggacaaggaaggtttcctgcgttcctatcgttccctcatccagacgattggtcgtgccgcgagaaatgtgtccggaaccgtcatcatgtatgccgatgacattaccgatgccatgcataaagccattgatgaaaccaatcgtcgccgcgacatccaaatcgcatataacaaagagcatggcatcgatccgaagccgttaatcaagaaaatcagcgacgtcaacgacatgctcgccaaggaagatgtcgatacgcagacgttgctcggtaccggctaccgtaatgaaggcaaagccggcaactcgcatcttggcgtgcctgctaccagcaaggaggaatctgacagacggcatgaggagattctcaaggccggattgcccgcgcaggatctagctgatctcattcgacaactgtccgagcagatgcatgccgccgccgaacagctgcaattcgagcttgcagctcgtttgcgtgacgagatccgtgacctgaaaaaggaacttcggcagatgacggaggcgagcaaatagttctcgaccggtcatgcggcatccgtaccatagtggattatggctgaaacaccacttgtttttgaaatcgccacgttcgcggtgcttgccgtcttcttcgtggttgacttgtttatcatcggacgtaagccccatgtgccctccaccaaggaatgcgtgcagcatatcgcgttctttgtagtcatggcgttgatcttcggcggacttatgtggttcttcgcgggattgaagccggccatcgaattttattcgggctggcttacggaatattcgctgagtattgacaatctattcgtcttcgtcatcattatgtcgaattttgcggtgccaaaacagctgcagaaattcgtgctgtccatcggcatcacgatcgcattggtgttgcgcggcgtgttcatcctcatcggcgcggccattatctcccgcttcacctgggtgttcttcctgttcggcgcatttcttatcgtcaccgccatcaagttggtcactgggggagacgaagatgaggaatatcatgagaatggcttgattcgtgcattgcgcaaggtgatcaagatcaccgatgagtatgacggagaaaagttgcgtaccgtcaaaaacggtgccaagtattggactccgatgctgatcgtctttctgaccatcggcaccaccgatgtgatgtttgcctttgactccattcctgcgattttcggtttgacgaaggatccgttcattgtgttcacgtccaatgtgttcgcattgctcggcttgcagcagctgtacttcctgcttggcgagctgctcgacaagctggtgtatctgcctcttggactttccgtggtgctgggcttcattggagtcaagctcattatggaggcattgcacggcaattcgttgccgttcatcaacggcggtcaaccgatcgcttgggtgcctgaagtgcctacatggctgtctttggcggtgatcgttgtggcgattggtggtgccgcattggccagcgtactgaagatgcgtgccatcgaagcaaaggaaaagtgacgatttgagaaaccgcatggaaacatgcggtttctttttatcaaaaaaatgtgagcgctcacaacacgcctcgtttcagggtggaagtgagcgctttttgctagtagactggtcggttggaaacagggtcgtcagatccaaaatcaatatcaacaagaataggcaggcattcatgcgtaaagccaagatcgtagataccatcggtccagctaccgagtccctggaaggcatcaccagccttgtcgaagcaggtatggacgtcgctcgtctgaaccgctcccatggcactccggaagaccacctcaaggtctacaacaacctccgcgccgccgccaaggccactggccgcaacgtcgcagccttggttgatctgcagggtccgaagatccgttgcggttggttcaagaagaacgccgacggtgaagacaaggtccagctgaccgaaggccaggagttcgtcatcaccaccgacgacatcgagggcgacgagcatatcacctccaccaccttcaagggcctgccgggcgattgccatgctggcgatccgatcctcatcgatgacggcaaggtccgtctcgaggtcaccaaggtcgaaggcaacaacgtgtacaccaaggtcgtcgtggccggaccggtctccagccacaagggcatcaacctgccgggcgttgctgtgtccctgccggctctgaccgagaaggacgaagccgatctgcgttgggccatccgcaccggcgccgacatcatcgccatgtccttcgtgcgtttcgccaccgacatcgaccgcgcccacgagatcatggacgaggaaggccgtcgcatcccggtcgtcgccaagatcgagaagccgcaggctcttgagaaccttgaagagatcgtcaaggccttcgacggcatcatggtcgcccgtggcgacatggccgtcgagtgcccgctcgaagaggttccgctggctaccaagcgttgcatcgagctggctcgtcaatacgccaagccggtcatcgtggctaccgaagtcctcggctccatggtcaactccccggtcccgacccgtgcagaggcatctgactgcgccaacgccatccttgacggcgccgacgccactatgacctccaacgagaccgccgtcggcaagtacccggcagtcaccgtgagcaccatgagccgtatctcctccttcgccaccgagcacggtttcgaccgtatcccggagctgaagaacctggatatgtcttccaccggcgctgtgtcttccgcagctgtggatctggctgacaagctgaacgccaaggctatcgttgcctacacccagaccggttccaccgtgcatcgcgtgtcccgcgaacgcccggccaccccgatctacggcatcaccaacaacgagcacacctatcactggctggctctgtcttggggtaccgagtccttcctgctcgatgaggattaccacgacaagtcccgcaaggacctgatgatcttcaccgataagatcctgaaggatgccggcaaggttaccgatggcgacaagatcgttgtgctgagttccgcccagggcgagcaccagccgggtcgcaccgattccatctacgtccacaccgtcggtgcttgcgactgagatgcgtttcggtcagtggctgactgattagcgaataggagggcttccgtccatttggatggaagccctcctattgttttcggatgatgttgattttgtggtcgatttatagatcgcgataggttgtgattaagctgccgcgcatggtgcgaaacgccgaccactcaaggactttgcgaaatcatttttctgtgttaggataatcaagttgtgcgaaagcccctgtatcccaattggtagaggagacagcctcaaaatctgtacagtgtgggttcgagtcccaccgggggcaccggattgatgaacagccgtggttggaaatttccagccgcggctttttgttatacgttccccgtacgcagggccagttggtaccgtcttctttgattcagatggcgagccgggcgccggtgttgccggcgcgccgccggtaacaccgaggatgtgcgaacttctcccagatgctgtaagactgcgacggccccggcattgttgctggattggcatggtcttcgacgtgcgcctcttgtctgcgatgtctttcgtttattcttataagtgaggtttttgtttcgcttcgctgtccaagcgacacggaaccgaaagtttcaataaaggaagacatctgtcgcaggcttctgccggttgtccggcgtgagacagaaagctaatgatccgagagccgatcgaagcgctctggtagcgattccacgccaatggcgtggatgtgtcccgccgtggatttaggtctctcttacttacgaggatgcccagacacatccacttttttggcgccggatgtgcggcagttccgacggatgcttgacattcgggggaggttccatcgcgggaacgcgtggtttgtttggctcaattaagcagctttcgggagtccggagcctgtcaaggccactgtgcatagattcactccgaactatggcatcgtcgctacggtgacattcaccgataatcctgaagtattccatattgaatttctgcaaggcattcagtggctccctccggttttacttcaatcaatcacaatgccaaaatgtcctactgcggaggattctttcaaggaggatttgaataggcagattgagagttggcatgacgattggattactgcaggcgaatcgtggggctaatccggccaaacgcaaatgctgtatgtctgggtcgccgatacggtgagtcggcagccagaacaatatatggtttatatattgcgtgaaaatatgtaggttttgtgattgcggttacgattgcgggcgggtagtcgtttccctgtccgcaatcgtaaccgcaatcgtcgtatcgatatgtcggagtgttactcggacttgcagtcagcgtcctcaacagcagcgtcctccgccagctgttgcatgagctgttcgtcgcgctcgcggataatgcgttgtccgtcttcgccttgccattcgtagaaaccacggccggtttttgtgccaaggttcccatcctgcactttccaagccagcagagggctcggttcggtgccgttatccatgtctttgaacaggtaggtgctgatgttgtagaacgtgtccagtccgcccaaatcggcgctggccacggggccgacgagattccagcgtcgtcccaaactgtaacgaaccacagtgtcgacggtttccgcgtcggcgatgccttcattgatgatgttgaacgcctcgcgcaacagcgccagttgcatacggttgcccacgaatcccaaagattcctttttgattttcgcaggctttttgccgatgcttgccatcaaatcgaaggtcgtatcaaccacttccggcgcagtgtctttgccgggcaccacttcgactagcggcatcagatgcgcaggattccagaaatgagccaccacaaagcgttccgggtgcttcagcacagattggattgcggttgggcccaatccggaagtgtttgtcgcaaagatcgcatcgaccggcgcgtactgctcaatctgctgccatacggattgcttgacatcaagcttttcaacaatggattcgataatgaaatccgcgtcggagacaccattttcatagtcggtgtatgtcgaaatgcgggagagcacatcgtcaacggtatcttcggcgcgcagcaacccggcttgggcgaattcctcggcatcggcgcggatatgttccatgccacgcttaagaagctcttcgctgcagtccaccaatttcaccgggtatccggcgaccgcaaattgcaacgctgtggcatgccccatggtgcctgagccgatattggcgaccgttcgtatggattccaaggtttttggttctatggtttgtaccgtggcatctgtcatcgcaacctcgcaatcctcgtatggcgcttccatgcttccactacgagcgagcctagtcgccaatctgggaattatatgaaagcgccatgttcggtgtcgatgccttgcggtcggcgtgctttactgacagtgctttactgacggtgccttactttcagtgctttaccgacggtgccttactttcagtgctttaccgacggtgccttactttcagtgctttaccgacagtgtttgctgcagggtatgcgaatcgtgtggaggcacgacgaccgcgcagtcgcgattgttgacggcttccacgcacacgaagccacgccattcgccgtcgctcaaatctccgatggcattgccggcttgttctcccggattccataccacggtctgcgctgcgccctgcttggcgacaatgatggtgcgctgcaacacggggtcgcgcagctcaagcgtatccgccgaatagtagatgcggtcaaccatgccttggaaggtcacaggttcattaccttggctgcaacggggatcgccgtccaatacggtatcgagataatcggtgccctccagcccgcacacctgcgactgttcggcgtcgccaacctgcagatacgtatgcagtgcctcttcgtaagacaatggctcattgccatcgttatatacggtaagcgacatcgtcaatttacggccgacttcaatggtgtaaacggcatgaaattgaggattcggtccagaaacaaactgggaaagtatatctgcgttgatctcgctggaatccaatgtatagcgcaacaaggcatcggaagaaccttccttgtcataatgccagaaactgttgcgggcaaaaccatgcttgggcttcttcgaagccacatgcccgccttcgaaaccggaattgaaccaagggaaaataatcggaacaccgccgcggatggcagttccttccttaagatgaatcgcctttggccgccaaaccacagtctgttcgccggcaggtgcccaggaaagcacatgcgcaccgtaatcgctgactgatgccgttgcgtcttcgttgacaatatctctgatagtgaaagtgctactcatacgaccagtataaacaagacaacgttgaggcgggattgtggaaagaaggactttgcaggattgcggaatttcttggatttttcggctttgcacgtgaaggaaaaagaggattgcggcaacacgcgcttgtaggcttctgctagtatcatccatgaaagtacaaggaagatagccggttcgttccaacttgcgtgatggagggtgaatcaaggctgtgaaaagctgaagatttccagaatccgaacgattgcaagtaacggcatcgaatcagtccaggaccaggttggggtttgtgagaccggctttgggtgtgacagtggaaagagaccgacatgtctgcagaaaagaccacggaaccggacgaagtgctcaccgacgatgaacttcaggctgccgcagcgcctgagcagtccatcgaggaagatgacaaacctcgcaagcgtaccgtcgtcgtggccgaagacgaatccgtgaaccgtatggatttggttgccatgctggaagatagtggctacgaggttgtgggcgaagccgctaacggtgaggaagcagtcgaattgacccgcaagttccgtccaagcgtggtatgcatggacgtcaagatgcctcgtatggatggcatcgaagcggcgggcatcatctgtgatgagaatatcgctccggtcgttatgcttacggcattctcccagtccgatctggtcaagaaggccacgggtgcaggtgccatggcatacgtcaccaagccgtatgaggaatccaagctgcttccggctctggaagtggccatgggccgtttcgccgaaatcaacgatctgctcgacaatgtggagcgcagcgaatccaagctgcacgaaaccgaagagcagctgaagaaggcggaagagcagctgaagaaggctgaggaaaccctcgaggaacgtaagcttgtcgaccgtgccaagggcctgctgatggataaggctgacttctccgagcagggcgcgttccgttggattcagaagacctccatggaccagcgcatcccgaagaagcgtctggctatggccatcatcgccaagtacggtgatcagaagtcggaagcagaggatgagcgctaacacagcaactgtggaaggcactacgcgcgggacgctattggtcgttgacggccattccttggcgttccgcgctttttttgccttgcccgtagagaatttcagtacatccgcaggtcaggcgaccaacgccgtctggggcttcgccaccatgctgtcgcaggtgatcgacgcggaacatccggatcatcttgccgtcgctttcgatgtcaaaggcggtaccttccgcaatacgatgctgccgcagtacaaaggcacgcgagatgcggctccggaagatttattgacccagctgccgttgattcaacggatgctgacggcccttggcgtcacattcatcgaaaaacctggatacgagggcgatgatgtgatcggcacgttggcaagcatgggagacaaagcaggctatcgcacgctggtgctatccggcgatcgtgacgcgttccagctcatcaacgacaacatcacagtgttgtatccggggcatcatttcaaagatttgaagcatatgactcccgacgcggtggtggagaaataccacgtcacgccggagcaatatccggatcttgccgcgcttcgtggcgaaaccgccgacaacatccccggcgttcccggcgtgggcgatggattcgcggccaaatggatcaacctgtatggcggacttgaccagattatcgagcatgccgacgaaatcggcggcaaaaaaggcgaggcgttgcgggccaatatcgatcaggtcaaactgaatcgttccgtgaatgccttggtgcgtgaccttgaccttggcgtgtccatcgaggatttgactttcggtcaggtggacgccaaccagctcaaccaactgttcaccagacttgaattcggcatacgcaccaaaaaccgtgtgctgagaacattcaatgcggggaagcccaccaacgatcccgtgcagcaagacgagtccggcaagctcgaaatacctcagtatgaaacggttgactcgccggaggcactggaatcatgggtgcaatccaatctgcaggcgacgaacaagcatctgcatgatgagcgagaaatcgcgccgaaaacaactccttccggcttcgccattgatcatacgaagaagtgcgcacaatccgtggcccgctcatgggtgttgcaggtggaaggcgaaagcaagccagggaacgcggcttattcgtcgctgatgatcgcatcgcaaggcaaagcgattcgcatcaatcatattgatcgcgatatggcgtcacaactgcaaacggtacttgacgaacaccaccaatccatggtggtgcatgggtataaggaacagtcccacctgctggaaagcgtcggtgtggcgttgccgaagccgctgttcgacaccaagcttgccgggtatctggtccatcccgatttccatgccgacacgctggaacgggcggcggcgcatttccttgacctgcatatcgaggaacagtccgagggcgcgacgcaaggcacgcttgatttcgacgagccggacgatagtgcgcagcggaacgacaaccagcttccgcgccatactgcgattgttggtttgctggcgcgtaaactggcggattcattggatcagcgtgagcagttctcattgcttgaatctgtggagattccagtatcccgtgtgctgtatggcatggagcatgccggtgcgcaagtcgatatgaacaggctgatgagcatgcgcgaacagcttgccgccgacgcgaattacgcgcaggaaacggcatggcagtatgcgggcgagcgcgtgaatctgcaaagtcctaagcagttgcagaagattctgtttgaggatatgggcttgaagcctacgaagaagactaagactggttcgtatactacgaatgcggctgctttgcaggtgttgcgtgatcgttcgtatggtaatgatagggcttgtcagtttcttgatgcgttgttgttgcatcgtgagaagaataagcttaagcagattgtgcagacgttgattgatgcgacgaacaggtctgatggtcgtattcatacgacgtttgagcagactgtggctgcgactggtcggttgagttcggttgatccgaatttgcagaatattccgaatcgtgatcctgctggtcgtgagattcgttcggcttttgtgcccggtgagggttttgagtcgttgttgagttcggattattctcaggttgagttgcgtattatggctgatctttctggtgatgaggcgttgattgaggcgttccgttccggtagggattttcataagtatgtggcgagtttggtgtatggcgttcctgtggatgagattacgtctgatcagcgcagtcatgttaaggcgatgagctatggcttggcatatgggctgagcacgtatgggctttcgcagcagcttggcattaagccgggtgaggccgagtcattgaagcggcagtattttgcgacgttcggcaaggtccatgagtatttggagtcgttggtttcttcggctcgtgaaaagggatatacggagacgatttatggtcgtcgtaggtattttccgggcttgaagtcgccgaatcgtgcggtgcgtgatgctgcggagcgtgccgcgttgaatgcgcctattcagggttctgctgcggatattatgaagatcgctatgattcgtgctgatgatgcgttgcatgaggctggtcttgccagtcggattattttgcagattcatgatgaacttgtggtggaggttgcgccgggtgaggcggagcgtgtcactgcgttggtgaaggatgccatggagcatgcggtcgatatggcggttccgttggatgtttccacgggtattggttcggattggcagcttgccgcgcactgatacggtactgggtttcgtgtgtgttgcggatgtgcgtggtcgagcaatggcataaggaggaatgatggcaacgctgaagcaggttgtggatgtgctggaaacgttgtatccgcttcgctatgcggagcagtgggatgagcctggtcttatcgtgggtgatttgcgtcagcctgtgcgcggtatcgcttttgcggctgatccctctatggcggtggttgatcaggcgattgccggtggtgttgatttgctggtttgccatcatccgttgttcttccgttccgttcatgcggtgtcgggattgggtttccgtggtgagattgtgcgtaagctcaatcttgccggatgtgcgttgtgggtggggcatacgaatgccgatgcggcgtatcgtggcgtcggcatggctgcggctgacatgttcggtttggtggatcagcgtccgctggtgcccatcgatgatccggatgccgagcatccggtcggtttggggcgtgtggggcgtcttgccgaacctgtggcgttgcgtgatttcgccagtcgagtagctggcgcgctgccgtacaccgagcttggcgtgcaggtttgcggcgatctggacgttccggtcagcacggtggcggtgcttccgggttccggtgattccttgttcgatgaggtgcgtgcggccggtgccgacgtgtatgtgaccagtgatctgcggcatcatccggtgacggacgccatagagcaggcccgctatgaggcttccatgcgtgcttccggcgttgccataggccatggtgacgggcgtgtgcgtccggcgttcgtcaacactccgcacagcgctatcgaatccatgtggttccagtatgcgatggaagacgttccccatgcggttgcggaagcgaccggcgacattcctgccgtgcgttggatttccatgaataccgatccatggaatatggtatttccttcgagcgggcaggaacggtgacgcgtcatgtgtgacgaggcggtagacggaacccaggtggacgtattgctggatgaatccagcgatggcgtggacatgtccggtatggtcacggtgcttgacagcaggcacgtgtatcagggtgcgattttcggcgtcgacgacctgcggatcgcattgccgatgcgtgacggagggcaaacggtgattcgccgtcaggtgatgcgtcacgcgccttgcgtggtcatgctggtgcatgattgcgcgaatgacctgtatctgatcgaacgggaataccgtatcggctgcgacgccttcgcctacggtctgccggctggactcatcgacgggggagaggacgtggaggaggccgcgctgcgggagcttcgtgaggaaaccggtgtggagcccgccgggcgtgacggtgtcgaattcgaccatgtggggcagttttactcgtccgaaggcatgaccgacgagcttgccaacatcatggtgcttcacctgcatgcatggcatcccgtcgaacgtcatttcgacggcgatgagcacgtcgaatcggcgtgggtctcctggcagcggctgcgcggcacccgtattacggcctccaattccatgatcgctattcttcacgagcaaattcgacgaaaccggcaaaatacaggcaagagttctttcgaatcgtaaaaataatcgccgaacaacacgaaattgcgatttgggggctgaaacgtgagatacttgaatcatgcaaatcagacccggatcgatgtatccactcggcgcaagctatgacggcgccggcgtgaattttgccctcttttcccaagtggcacaaaaagtcgagctttgccttttcgatgaggaagacaacgaaactcgaatcgaaatgaccgagcagaactcttatgtctggcacaactatctgcccggaatccaaccggggcaacgttacggctatcgcgtgtacgggccatacgacccgacgcaaggcctgcgctgcaacccgaacaaactgctgcttgacccctacgctaaagccatcgaaggcaacatcgacggcgatgagagcctctactcgtactggttcagaagccccgatgacgttaccagcatgaacacgctcgactcggccgcccataccatgaaagcggccgtggtgaacccctatttcgactggggcaacgaccagcatccgaacatctcatatcacgattccgtgatttacgaagcccacgtacgcggcatgaccaacctcaacatggacgtgccgccggacattcgcggaacctatgcgggtctggcgtacccctcggtaatcgaatacctgaagaagctgggcgtcacggccatcgagctcatgcccatccaccagttcgtcaatgacagcttccttcaggaaaaaggcctgagcaactactggggatacaacaccatcggcttcttcgccccgcacaacgcgtattccagctccggacagcgcggcgaacaggtcaacgaattcaaatccatggtcaaggcataccatcatgccggcatggaagtcatcctcgacgtggtgtacaaccacaccgccgaaggcaacaaccgtggaccgaccctcagcttcaagggcatcgacaacggcgcctactaccgtctggtcgacaacgaccgcagacactacttcgacaccacaggcaccggcaactcgctgctgatgcgctcgccgcacgccctgcagctcatcaccgacagcctgcgctactgggtcaccgaaatgcacgtcgacggattccgattcgatcttgccgccacattggcccgtcagttccaggaagtcgacaagctgtcggccttcttcgacatcgtcgaacaggatccggtgatctcccgcgtcaagctgatcgcggaaccgtgggatctcggctctggcggctatcaggtgggcggcttcccgtccagctggtccgaatggaacggccgctaccgcgattgcgtgcgcgacttctggcgctcgcagccgtccacgttgccggaattcgccagccgattcatgggcagttccgacctgtatcaggtcaatggccgccgaccggtcgcatccgtgaacttcatcaccgcgcacgacggcttcaccatgaacgatctggtgagctacaacgagaagcataatgaggccaacggcgaaggcaatcgcgacggcgaaagcaacaaccgttcttggaactgcggtgtcgaaggtcctacgaccatcaaggatgttaacgagcttcgtcaacagcagatgcgcaacatgttcgccacgttgctgctcagccaaggcattccgatgatctgcggcggcgacgaagtggcgcgcacccagcagggcaacaacaacgcctactgccaggacaatgcgatctcctggacgaactgggatctgggcgaggatcaaaaggacctgctcgaattcgtatcgaagctgatccatttgaggcttgagcatcctgtgctgcatcgccgccgcttcttctccggtcgcgagcagggagacgacagcactgcgattccgcaggtcgaatggatggatcataccggctccattatggatatggacgactggtcaaacacacacgccttcactgtgatgatctatctgaacggttccgatattccggaaaccgactggtacggcaatcagatggtcgacaatgatttcattctgattttcaacgcgcattacgagcctatcatgttcaccctgcccgatgagcaatatggcaagaaatggcgcttaattgtcgacacgcataatccaaaggggccagaactcaattatgaggccggttttgcgattactgcgcaatcaagaagcttcctgctgttgatgagcgacaagaagccgtccaacaagcactacaacttctgacggcgcactcgcgttatgccgtcagaatccagtggggtggagtcgtcgccaatgcgatggctccaccccactggtatgtatatgttgaaatccggcggttgccggtcagccttgcatcagacttgtgcggcgagcctcgaaactgtgtcgggaacagtttcgctgacttccgcaagatcctcgacggagcgtggtctctcagattgcgccagtatcagctgcgtctgcacgcgatccgcttcgatggcggcgatttgacgcgagaaaatgatgaaccagccaaggaacatcatgccggccaacgcctccacattcgtcagcgtgttatgcccgctcagccattggaatccggcataagccccaatcgcaatcgcaagatcggaaaccacgtatacgacctttgagagttgcggggcaagccaaggcagggcaatcatcagcacgctcatcaaacatggtaggccgcgggcgaacacgttgtgcaaaatcggatgcggcgtgtaacggaacatgccgatacctacgaaagcgatgccggccaacgtcaacatgattgacagcagcagaatcctcgtacgaaaatgcttcggcgtctcattgatggcattggaatccagatactgcaattgcagacgatacgtggtgatgagctcggaaacggcgaaatagctgatgatcacaatgcagatgcccgcgagcgtcagcgtcgaattgaacatacgcgcggcgaacgtcgtacggtcgcccaattgagagaaattattgttgtaccagtacggatcgtcggacgtcaatcctgcgatactcacgccagacaccacgaaaaacggcagtagggaagcgatcgttttggcattcataagttccgcctgcacgaaagtgatatagcctacaacgcctgcgatggccgcgcataggatcggcagatagcctttcagcgtgcggatgcccatcatgttgttgacgatggacaacatcatgaacgatgtgacgaaaatggtcgaagcatacaccatggaaagcgcgaggatctcgaaaatacgacggaccggaatagcccaaccatgtttgagtgtcagcgaacgtgattttcgtgcgtaacccaaactgaatgaaacgactccgcatcctgccacgattcccgcgcagacggtgaacagacgctgcgtgacacgccagatggccggggcgaactgcatgtatgcgttcatgacgaaccaggcgataacggcgcatgtcacaaaggagatgatgcctgacgattcggcctgctggtgacgtcccatgccactctcccttccgaaatgctattgtaagcctgtcgttgtccaaccatacgctataatagaaactcgtgttcacatgatgcgattccgtgaggcggattcgcggggtgtgaacgtgaacgggctgtagcgcagtttggtagcgcgtctgctttgggagcagaatgtcgcaggttcaaatcctgtcagcccgaccaaaaccgttggaaacaaaggtgtttcagacggtttgaaaaatcctttctccggtttccggtacaaacacgacgatcgcgggaattcctcgtggcattttgtgatattcgcatagttctgtccgcctgggttttcaaacggaaatggtatggatggcatttgattgtcgagttcgagcaagatacgggtgctgtatggcgagattgaagcgttgttttcctcgggttttggatacgataagccctatgaacgcatctcaagagaatctttggccggcgccgtttgccagcaaatcgcttgacgccaccgttgtggtgccgggcagcaaatccctgtcgaaccgttatctcattcttgcggctctcgggcatcgtcctgtgcgattggtcggtctgttgcgctcgcgcgataccgagctgatgatggacgcgctgcgttcgttgggagtgcgctgcgaaatcgatgagcaggtcgacaccacggttacggtggtgccgccgtccgacggccggttccacggtggtacgaaggtgttctgcggtcttgcgggaacagtgatgcgctttgtgcccggtcttgccatgttcgcggacggtcctgtggatttcgacggtgacgagcaggcgtacgcgcgtccgatgaagccggtgttggacggtcttggacagttgggggcatgcatcgaataccacggcgaggaagggcgcctgccatttacaatcattccacctcaaacggtgagccagtgcgccgagccgagcgtagtcagcattgattcttcgggatcctcgcagtttatttcgggactattgctcgtcggctctcgagtgccaggcggtttggaactgcatcacacgggggagaagacaccgagtttaccgcatattcgcatgaccgtggccgatctgcaaggttccggcgtgcgcgccaacgccgacgaacacgcccgcgtgtggaccgtgcagccgggagccgtgcagttgcccgaaacggtgacggtagaacctgacctgtcgaatgccgccccgttccttggcgcagcgctcatcgccggcggaaccgttcgcgtgcctcactggccggaatccaccacccagccgggcggcctgcttcccggatacttggaacatatgggcgctgaaatcagcttccccgtgatcgacggcgtccggtactgcgaagtgaccggcagcagccatatcaacggcttgggtgatttcgacctgactgcggccggcgagattgcgccatcgctggccgcaatcttggtcttcgccgacaagcctacgcgcatgctgggcatcggccacttgcgcggccacgagacgaaccgtctggaagcattggtcaacgaaatcaccagagtcgggggagaagcccgtgagcttcccgacgggctggagatcgtgccagtgccggcaacgaatctcaagcccgccaaaatggaaacctacgcggaccatcgcatggcgacgttcgccgcaatgcttggtctgagcatcaacggcatccaagtcaagaacatcgccaccaccgcgaaaacgcttcccgatttcgcaaacatgtggaccagcatgctggcctagcaatgattgtctaggataatccgcaaataatattgaaaacggtatgaaaatgtccttcctccgcaaaaacggaggaaggacattctacgtttgcacaggatcgtaatcattctgcggatgccgctatgtcaagccacgatggttcttagctttcctgacacggcttggccttgtccggccccaacatggcaaaggtagtggcgctcgcaaacgtcataatgcctacgaaaaacacggaaccaatggaaacctgacaccgtacgtaaagaggtaagcagcgacgaggcgtccgacaccttgagaggtgttatctggctcgagcctagaaggcggaaagcatgatgaagccccggaagtttcgcactttcgggggcttcatcatattgattgcgattttgcgttcagtaacgaatcagcttggaatcactcccactcacttgtttgaactgggagaggcattttgcgccccctctgagcaaaaatttttcaactttttttgaaaataaaaaaagccgcctgttttaaatttgaggtcaacagatggcgggtagaaattttcatatttatgatgtataatatgtgatattaaagattgataaatcagaatttgtaggtgcgattgatgaaaattattgaagttaaagaaaataaaaaacaatatcttgatttgctcctattagcagatgagcaggaagatatggttgaccgttatcttgataacggcaagatgtatgtacttgatgataatggggtcaagtgtgagtgtgtcataaccgataaagaaaatgacatacttgaaatcaagaacattgcgacggttccagaatatcaagggaaaggttatgcaagagccttaattgagtttattgttaataattacagagagcaatatgccattctgcaagtgggaacaggcgatagcccactgacaataccattttatgaaaagtgtggttttgtccgttcgcatatcatatcaaatttctttatagataattatgaccacccaatctatgagagtggaatacagttggtagatatggtgtatttgcaaagaccgttataatttaaattcaagtttatggagagtcaccgttatgattagagaatttaaaagggatgatataaataaagttgcagatatatggttggatacaaatataaaggcacataattttatccccgccgaatactggaaaagcaatttcaaatcagtaaaagaagcgctgttactagcagaggtttatgtgtatgagtatgatacagaaatacagggttttatagggttaaatgatgaatatgttgagggcatttttgtttctggtgaaatgcaatcgcagggtataggtaaaattctgctgaattatgcaaaggataaaaggaataagttgcacttgaacgtataccaaaagaacgcacgggcaatatctttttataagagagaaggatttgagattcagcatagtggcttagatgaggctaccggagaaaaagattatgtaatgacatggcaacacaaatagaaattccagtttatcgaactaaaacataagaccgcttacatcgtgtaggcggtcttatgtcgtggcaagattatttgattttaagctttcttttcttggcagaaagcactttgcagagaacatcatcgacggcgtcggtgtatctgccttgttcaatcaatttgtttttttagatttataaggaaagcaacaatttcgtttctttcttttgtacttaaatatatatggtattttttctgttttcatactatccacctcgctgttttatctgatttgatgatatattaaagagaaaattttatcaaatatgcaaaaaggcttctgcctaaaacagggcaaaagccttaaaaatttgcgatttttaggtttagttgcaagccaagggggactatttcatctgttgcaaaatcggttgcccgaaaagtaccaagtcccgaaacccgcataaatactgggtttttcggcacatctaaaccaaggggaactactcccactcgatggttgccggcggcttggaggtgcagtcgagcaccacacggttgatctgacggcattcattggtgatgcgcgtcgaaatcgtggcaagcacatcgtacggaatgcgagaccagtctgcggtcatggcgtcttcggaggaaaccggacgcaacacgattggcgaaccatacgtgcgctcgtcgccctgcacacccacggaatgcacatcggcaaggagcacgaccgggcactgccagatatcgcggtcaagaccagccttggaaagctcctcgcgagcgatggcgtcggcctcgcgaagcagatccagacgcttcttggtgatttcgccgatgatgcggatgccgagacccgggccagggaacggctgacgccagacgatttcgtccggcaatccaagctcggtaccgatggcacgaacctcatccttgaacaaggtacgcagtggctcgacgagctggaacttgatgtcgtccggcaggccacccacattgtggtgcgacttgatgttggctgcgccgtcgccaccgccggattccacaacatccgggtagagggtgccctgaacgaggaacttgacttccttgccggaagcacccgcctcttcgatgacctggcgctgagccttctcgaacgtgcgaatgaacttttcgccgatgatcttgcgcttcttctccggctcgctcacacccttcagagcggtgaggaagtcttcggaggcgtccacggcaatgagcttgatgccggtcgcctcgacgaaatcatgcttgacctgctcggcctcgcccttgcgcagcagaccgtggtccacgaacacgcaggtgagctgatcgccgatggccttgtgcacgagagccgccgcgactgcggaatcaacgccgccggacaggccgcaaatcacctgtgcgtcgccgaccttctcgcggatcttcgcgacctgatcctcgatgatgctggaggcatcccagttgttgccgagccccgcgcacttgtgcaggaaggtctcgatgagctgctggcccatcggggtgtgcttgacttcaggatgccactgcacgccgtacagtttgcgggattcgtcctgcatggcggcaacgggcgcgccctcggtatgcgccagcacttcaaagccctccggcgcggtcttgacggccacgccatggctcatccacgtgttctgatcggcgggggagccgtcgagcagaccttccgacttgtcgatgaaggtctcggtcttgccatattcgccaagggcggccttgtcgacattcgcgcccaaggcataggccatggcctggaagccgtagcagatgcccagtacgggaacgccggcctcgaacagtttcttgtccacacgcggcgcgccaggctcgaacaccgaagccggaccaccggaaaggatgatggcctgcggatccttggccagcatctcgtcgaccggcatggaatgcggcacaagctccgaataaacattggcttcacgcacgcgacgtgcgatcagctgggcgtactgggctccgaaatcaacaacgagcacaggacctgcagccataacactctcccttttaatatgaggtatgaagaagcaacaatattaactgttctattgtggcgacgcgagcagacattggaaacgctgtgaacagaaagtgaacaaacctcacaattgcttactatgcatggttcaacacgccgcatgcaagtattgcaaaacgaacgtgaaaaaggtgtgaggatggcttgaaatcgttgatattgagccgtttatcaatctttttgatagcatgtgaagtattcacaaatctcccgataaaagctctcattttctaacagaaacgacacacttgcgcacacagtcgcaaaaaaacagcaaaaagtcgcacctcgctcgtaatatgctcaagtgattgggaatgaatcgttccgcggaaccgcaaggttttgcaagattcaggaccgaatgaaaataaacaatcgcacaacacagtgcaggagtacaggagtacacatgacgagtcctgttattggcaccccttggaagaagctgaacgctccggtttccgaggaagctatcgaaggcgtggataagtactggcgtgcagccaactacctctccatcggccagatctatctgcgtagcaacccgctgatgaaggagcctttcacccgcgaagacgtcaagcaccgtctggtcggtcactggggcaccaccccgggcctgaacttcctcatcggccacatcaaccgtctcatcgctgatcaccagcagaacactgtgatcatcatgggcccaggccacggcggcccggctggtaccgctcagtcctacctggatggcacctacactgagaccttcccgaagatcaccaaggacgaagctggtctgcagaagttcttccgccagttctcctacccgggcggcattccgtcccactacgctccggagactccgggctccatccacgaaggtggcgagctgggttacgccctgtctcacgcctacggtgctgtgatgaacaacccgagcctgttcgttccggccatcgtcggcgacggcgaagctgagaccggcccgctggccaccggctggcagtccaacaagctcgtcaacccgcgcaccgacggtatcgtgctgccgatcctgcacctcaacggctacaagatcgccaacccgaccatcctgtcccgcatctccgacgaagagctccacgagttcttccacggcatgggctatgagccgtacgagttcgtcgctggcttcgacaacgaggatcacctgtcgatccaccgtcgtttcgccgagctgttcgagaccgtcttcgacgagatctgcgacatcaaggccgcagcccagaccgacgacatgactcgtccgttctacccgatgatcatcttccgcaccccgaagggctggacctgcccgaagttcatcgacggcaagaagaccgaaggctcctggcgttcccaccaggtcccgctggcttccgcccgcgataccgaggctcacttcgaagtcctcaagaactggctcgagtcctacaagccggaagaactgttcgacgagaacggtgccgtgaagccggaagtcaccgccttcatgccgaccggcgaactgcgcatcggtgccaacccgaatgccaacggtggcgtgatccgcgaagagctgaacctgccggccctcgaagactacgaggtcaaggaagtcgccgagtacggccacggctggggccagctcgaagccacccgtcgtctgggcgtctacactcgcgacatcatcaagaacaacccggactccttccgcatcttcggaccggacgagaccgcttccaaccgtctgcaggccgcttacgacgtcaccaacaagcagtgggacgccggctacctgtcctcccaggttgacgagcacatggctgtcaccggccaggtcactgagcagctctccgagcaccagatggaaggcttcctcgaggcctacctgctcaccggccgtcacggcatctggagctcctatgagtccttcgtgcacgtgatcgactccatgctgaaccagcacgccaagtggctcgaggctaccgtccgcgagatcccgtggcgcaagccgatctcctccatgaacctgctcgtctcctcccacgtgtggcgtcaggatcacaacggcttctcccaccaggatccgggtgtcacctccgtcctgctgaacaagtgcttcaacaacgatcacgtgatcggcatctacttcccggtggattccaacatgctgctcgctgtggctgagaagtgctacaagtccaccaacatgatcaacgcgatcattgctggtaagcagccggccgctacttggctgaccctggacgaagctcgcgctgagctcgagaagggcgctgccgagtgggagtgggcttccaccgccaagtccaacgacgaagcccagatcgtgctcgcctccgctggcgacgttccggctcaggagatcatggctgctgccgacaagctcaacgagctcggcatcaagttcaaggtcgtcaacgttgtggatctggtcaagctgcagtccaccaaggagaacgatcaggctatctccgacgctgacttcgctgacctgttcaccgaagacaagccggtcctgttcgcttaccactcctacgctcgcgacgtgcgtggtctgatctacgatcgcccgaaccacgacaacttcaacgtccacggctacgaggagcagggctccaccaccaccccgtacgacatggttcgcgtgaacaacatcgaccgctacgagctcgttgccgaagctctgcgcatgatcgatgctgacaagtacgccgacaagatcaacgagctcgaagccttccgtcaggaagccttccagttcgcagtcgacaacggctacgatcacccggattacaccgattgggtctactctggcgtcaacaccaccaagcagggtgctgtctccgctaccgccgcaaccgctggcgataacgagtgagtctagcctctataggctgattgcttgaacaaagccccaagggattttcccttggggcttttgccatatccgtaactttgtaatgcgttgtgacaccatgtcatgaaatgcgtgtctgttaccgttcacgcattacaatggcacatggtgcgaaacagcgcagtcacacaccttaaaaacaacgaataggagcagacatcgtgagtctaaccagcgtcaccattatcagccctgaagcagcaaacggccgcaacgtcgtggcccttggcgtcaccaaggcattcgcagctgccaagaagacggccgtgttccgtccggcggtttgtcgcaaggaaaccttcaccgacgttcttcttgaagcaagcaactcggggctgagccgtgaacaatccgtcggtgtttgcccgaagcgtgcacgcaccgacaaggaaggttcccgggccgatatcgtggccgcctacacggaagccatcgaaaccgcccagcccgaagccgtggttgttgtcggaacggacaaatccgccatcaacgacccgtccatctttgcgttcaatgctgacgtagccgctgatctcaagtctgtcgtgcttcttgccgtatgcaccatcaaccgcactccggaacaggtcctgggcactgtcgaggcgtcgaagaccatcatcgagaatgcaggcagcaaggtcgccggcgtgttcatcaccggatgcaaagacgaacaggtggaacctctcaaggaggagttcgcagcttacgaggtgccggtgtggacgttacccgccgttgattttgacgaggaagacgccgtgaccaaggccacggaggcattcgaggcgaatgtcaacgccgaagagcttatctccgctgttgaggctccattcgaggcgccgaccacgccatacgcattccagtacagtctgctgggcaaggccaaggcggacaagaaaaccatcgtgcttccggaaggatccgaagaccgcatcatcaaggccgccgactacctgcttgagcgcgacatcgtcgatctgatcatcgtcggagacagggaaggcattctcgcccgcggcgaggagcttggtctcaaatccctcgaaaaggcgcagttccaggccaaggacgacgaggaagtgctcgctccgatggtcgccaagctgtgcgaactgcgcgccaagaagggcatgaccgaagaacaggctcgcaagcagctcaccgacgacagctatttcggcaccatgcttgtggtgctcggcaaggctgacggtctggtttccggatccatcaactccacggccaacaccgtacgcccggccctgcaggtcattaagaccaagccgggaacttccctcgtgtccggcgcgttcctcatgtgcttcaaggaccatgtcgcagtgttctccgattgcgccatcaacctgaacccgtccgctgagcagcttgcggaaatcgccatccagtccgccgaaacggcaaaggcgttcggcctcgatccgaaggtcggcatgctgtcgtactccacgctgggatccggcaagggaccggacgttgatctcgtggaggaagcaaccgcactcgtgaaggagaaggctccggacctcgcggtcgtcggtcccatccagttcgacgcggcttggtcgccgaccgttgcagccaccaaggccaagggcaacgatgtggcgggccatgtcaatgtgttcgtgttcccggatctgtgcgcgggcaacatcgggtacaaggccgtccagcgttcctccggcgcagtggccgtcggtccggtgctgcagggactgaaccgaccggtcaacgacctgagccgaggcgcaaccgtgcaggacatcatcaacacggttgccctgaccgccatcgaagcccagtaaaacgctattttgtagcaagcaaagagtaatctaaagtttggaaagtcgcgcaagcggcacatcgattaacacatggaggatgcccacaatggcgaaaaccgtccttgtcatcaattccggttccagctctatcaagtatcagctggttgatcttgaaaccggtgaaggtattgcttccggcctggtcgagaagatcggcgagccggttgacggccactacaagcacgagttcaacggcgagaagcatgagctggaagagccgatccacgaccacgagcagggtctgaagcgcgtgctcggcttcttcaacgagttcggtccgaagctggacgaggccggcatcgtggctgttggtcaccgcgtggtgcagggtggttccatcttcccgaacccggctctggtcaccgacaagaccatcaaccaggtcaaggacctcgccgtgctcgcgccgctgcacaacggtccggaagccaagggtgctgaagtcatgcgcgcgctcctgccggacgtcccgcagatcttcgtgttcgattcctccttcttcttccagctgccgaaggccgcaagcacctacgcgctgaacaaggaaatcgccgaccagtaccacatccgccgttacggcgcccacggcacctcccacgagttcatctcttccgtggtgccgagcgtcatcggtaagccggctgaaggcctcaagcagatcgtgctgcatatcggcaacggcgcttccgcctccgccgaagtttccggcaagccggtcgagacctccatgggcctgactccgctcgaaggcctcatgatgggtggccgtaccggcgatatcgatccggccgtcgtcttccacctgatccgcaacgcccacatgaacgtggacgagctcgacgctctgttcaacaagcgttccggcatgatgggcatgaccggcttcggcgacctccgtgaggttcaccgtctggtcgccgaaggcaacgaggacgccaagctggctctcgacgtctacgtacaccgcatcgtcggctacatcggcaactacaccgctcagatgggcggcgtagacgtgatcaccttcaccgcaggcgtcggcgagaacgatgacgtggtccgcaagatggtgtgcgacaagctcgccccgttcggcgtcaagctggacgaagagaagaacgccacccgttccaaggaaccgcgcatcatctccaccccggattccaagatcaccatctgcgtcattccgaccaacgaggagctggcaatcgcccgcaagtccgcggcaatcgcagaagcaggcgaagacacttacggcaacgtcttctccaagtgagcaaggagatcccgcagtcaaatgattgacgggaccgtatgaagaggaccatacgttccattggaatcaaatccaatgccaatgggacgtacggtcctttctttttcgaataatccttatgtttcaccgcttttaaggtttcgatcgccgaacgtttccaatcgtcccagacaacacctttccatatctgttcatgatccgcataatgggggaggggctggtagtacgatacgaaacgttgtgcctaacgcgcatacgtcgcatgttgagagaagcggttgattgttgtggtaagacgtcgttttgtcggtctgaatggcctcaagggcatcgccttgatcgcgatagtgttgtatcactgcgaccagggcactctgcggggcggattcctaggcgttgacatattcttcaccatttcaggttttctgattttctcgtcgttgctgaatcatattgattccggcaagggaataggtttcaaggaatactacctcaagcgtctgcgcagaatatacccggcgctgattctgatgattcccgtcaccgtatcgttggcatggttcatcaaccaagacatgttggtggacattaacaaccagatagtgacggctatgctgggttgttacaactggtatgccatcggcagtggcgccagctatttctcgcagatgaatccagacatgttccgtcatctgtggttcatgtcggtgctgatacagttctatctgttggctcctttgctgatctacctgcttcgaaaaattctggtacgttgggtgccggtggcggtacttgccggacttgccgtgtgcagtgcgctttccatgggattgcagtatcacccgggaaccgatccaaccagagtgtatttcggttcggacacacatgccatgggactttggctaggtgccatgctggcatggctgctgatgatcatacggcgtggcaacggtcgtccggaagaaacggcgatcatggaacgcgctcgtctggtctggagcaagatcggccctgcggcggcttttgtggcattactgattctgttatggatgatgcagcacgttgagcagggtcctgctgccttctatggagggattttcgcggcttcgctactttcagtggttctggtcgccggttccattcctttcggatcttggatgcaggatctgctggtgttcaaaccatttgatgtggccggccgatattcatacggcatttacctgtggcattggcctttatggttgttcaccaaggcgatgttcccccagtggggtgctcggcatctgggatggatgctgctaatcacactcgctcttaccgcatgttgtaccgccatgtcgtggaagttggtagaacagcccgtcgcccgtggcggatttatcgccatgattcgcccgctgccagaaaacggaatgtgggatgtaaccagatgctggattacgatcgccgtggtattgagtacatgcttgatgtctggatacgcggtagccaacgcaccaaagcagaccagtgtggaacgcgcgttggaagagaatgcgaaaatgctgaaagagcagcagggcatgcatctcgacttcgataggaagcatccgccagcgcccaagaaacccgcatacaccatgcctgacggacagcagatggtcgcattcggtgactcggtgatgcttgcctccagtaaaggtttgcaatccgtttttcccggaatcactgttgatgcggaaacctcacgctcgatgaccaaggcattgggacttatagaccaagccaaaagccagccggaaggattgcgccaatgggtgctggtcggcttggctacgaattcagcggtgaccgatggccaactcaatgacatactgaacgacattggaccggatcatgtgcttgtgctgattaatgcgcatgcccccgtgtcttgggtccccggaacgaacgacgcgttgagcaacttcgcggccgcccattccgacaacgttgttctcgttgactgggacgctacgatttcggcgtatcctgatgagcttgccggagatggtattcaccctggcatgtccaatacgctgtacgcccaggctgtcaaggatgcgattgcgaactggatcaagcaaggacactgaaacatccttcttgcgaatcgcggcaaagcagttttgcgatgaatatgaggaatccccctgactcgtttgagcagggggattcctcataaccttttaggatctgaacggactcagtcttcctgatgctgcggagccgacagaaaatgctcttcactcggcagcagggcattcaacagcacggccacaacgaacgccacggcgatgcaattggatgcgaagatggactggaacagcggcgggaagttgacgaaaatgtcgccgacctgcgtgaagccgataccgatggtgagactcaacgccgcaatggtgatgttgcgctgcgtatagccggcctcggaaatcatctggaagccagacaggatgatgttgccgaacatcatgatggtgcagccgccaagcacggcctgcggcagggaattgaacacttccgccacggcaggcacgaagctggctatcatcagaatcagaccaccggaaagaatcaccttacggttgacgaccttggtcatggcgaccaaaccgatattctgtgcgaacgacgtcaacggcaagcagccgaacaggccggagacggaggagatgagaccgtcgcctgcaatggcgcccgcagtctccttatcggtaggctgacggtcgagaccaaccttggtgagcgcagcggtatcacccagcacctcaacggaagacacgacatacagcagggcgaaggagatgatcgcgcccggatcgaattcaagctggaacggcatgaaatgcggcacggacacaacctgcagattcgcgaaaccagagaaatcgaccttgcccatgaaaatcgcgacaacatagccgacaaccaagccgaacaacacggaaagctgcttggcagtacccttcatcagcagctggaacgccaagcaggcgaccagcgaaatcagaccgagcgtgagattctgccagcttccgaaatcctcagcgccggaaccgccgccgaaactggtggcaccaacggaaagcagtgagaaaccaatcgacgtaaccacaatcgcggatacgatcggcggcacgaagcgacgccaatacttggccgtcaaaccaagcgcaacctccaacaggccaccaagcacaaccgcgccggcgaccgcgccgtagccttggttctgggcgatcgacatggcagcagccacataggtgaaggaaatgccagtgaccatcggcaggcgggagccgatcagccacacgccatacagctgaaggcaggtgcccagacctgccaccagcagaccggcctgaataatcgtggcagactgctcggcactcatgttggcggcggaagccaccaagaaaatcggagccagattggccacgaacatcgccatgacatgctgcaggccgaacgggatgcccttccagaacgaaacaggcgcgtccaagctgctaagcgcttcaaaggaaacgcccttcttctcgttcgtgttgtctttcttcttctcttctctcacaatgaatcctctctcattcatgctgtgatgagtaacaggttgtaatggtttctgatgcgcgcccgtgagatgcgatgatcaggagcggaattcgatggtaccggtttccggatccatcgactccacgattgccagggaatcaacgtcgtatcccgctgcgcgcagctcatcgccgccgccctggaaacccttctccaccgcgatgccgatgccctcgaccgtcgctccggcatcatggcacagattgatcaggcccttcagagccttgccgttggccaggaagtcatcaagcaacagcacatggtcgccctcgttgagatacctcttggacacgatgacggggaattccttctgcttggtgaaggagtagacggtggtggtgtactggtcgccatcgagattgatggactgcgccttcttggcgaacaccacaggcgcattgccgaaatgacgcgcggcaacacaggcgataccaatgccggaagcttcaatggtcaggatcttgttgatggttttaccggcaaaatgttccgcccaagcggcacccatgtggtcgaacaattcgacatcgcactggtggttgaggaaagcatccactttcagcacattacctggcttgacggtaccctgcaggcgaatgcgctcttcgagctccttcatgaatccccttagattgttggccgcataaggcggcgttgatgttgacatacggtgaaccgcatataaacgttcagcatacgcgcgtcaattgaccatgcgagtgttgcgctgacctgcatgtgtgatagacatgaatttcgcagtaatcgacttcgaatcttcatggaaagaggaaccggtggagcagaatatgggaccagtcctgtgcgatccgcaaagtctgatcaaggacctcaatccgcagcaaatggaagcggtgaagtactacggacaagccctgctcatcggagctggtgccggatccggtaagacccgcgtgctcaccagacgcatcgcatggctgctggcacacggtttttgggcgagcagcattctcgccatcacctttacgaacaaggccgcggccgaaatgcgcgaacgccttgcggccctcgtagggcctgaagccgaacacatgtggatctccactttccattccgcgtgcgtgcgcatcctccgacgtgacggcaaggaaatcggtcttacctcaggattttccatttatgacacggctgattgcgaacgtttggtcaagctcatcagcggcgatttgaacatcgatacgaagcggtatacgccgcgcatgctattgggcaagatctcggattgcaagaattcgttgatttcatggcaggaccagctgaaaagcgtgaactgcgactacaagcccggccagcgcggatatcaggtttcggccggcgacgtcgacgagctggtcgccgtgatgtatgcggagtaccagtaccgtctggccatggcgaatgccgtggattttgacgatctgatcatgcgcaccgtcgaattgttccagcgttgcccacaggtgagcgaatattaccggcataagttccgttatattttcgtggacgagtatcaggacaccaaccatgcgcaatatgtgctcgtacgtgagctttccggcattgattcgggagaacagcccgatccacatatgcgaggggcaggccgtgtcggaccgtcttggattacggtggtgggcgattccgaccagtcgatttatgcgttccgaggcgcggatattcgtaatattcaggatttcgagcaggatttccctaacgcgaaaaccatcatgctcgaacagaattatcgttcgacgcagaccattctcgacgcagccaatgcggtgatcgcaagaaatgaaaatcgtaagccgaaaaaactgtggacggcacttggcgaaggcgacaaaatcgtcggatacgcggccgacaacgcgcaacaggaagccggatggatcgccaacgaaatcgcacgaatccacaacgaggaaggcgtggcgtatcgcgacatcgccatcatgtatcgagccaacgcgcaatcacgctcgctcgaagaggccatgatcaatgccaacctgccgtatcagctcgtcggcggcaccaaattctacgaacgcagggaaatcaaggatgcgctcgcgtatttgcaggccatcgtgaatcctgcggacaatgtgaacgttcgacgtatcctcaatgtgccgaagcgcggactgggcgttcgtgcggaaggactcgttgcctcgtatgctgatgcccatggcaccacttttttcgaagcgatcgaacatatggaacagatcgaaggcatgtccacgcgcacgacgaaaccgttgagtgcgttccgagacatgatgcatgagcttgcggcttttgcgaaggaccatgacacgaagccatccgaagtggttgccgaagtgcttgccaagagtgggattttggaagagctgcagcgctccgaggatccgcaggacgcttcccgcgtcgataatctttcccagctgcaatcagtggcggcggaattcgagcagaacacgccagacgccacattggcgggatttttggaaaccaccgcgttggtggccgattccgaccaattgccaggggagaacgaagattccggcaaggtgacgatgatgaccctgcataccgcaaagggtctggaatacccgtatgtgttcctgaccggcatggagcaaggcacattcccacaccagcgtgccatggaagacaccagcgaactggcagaggagcgccgtctcgcctacgtgggcatcactcgcgcgaagcgacgcctgtatgtgacacgcgcggccgtacgcgcgcaatgggggcaagccagcgacatgatgcccagtcagttcctcgatgagattccagacgaactgattgattggaaaagacgcgaagccggcgtcgaacgcatgcatgccagctggcaggatgacgacgacgagttcggcggctgggacgatgatgacgatttcggatcgatgtcattcggcggttcctcgtatggaaagtcggattatggttcctcatacggttccggctcgcggtggtctcgttcctcatacggatcgtcttcatatggggcagggcgctcgcagtacggcggcccggctacgcagggctcatcatcctcgtatggttccacatcccggcgctcgtgcggaggatcgggaaccggttcctcatacggctcgtatggttcgtatggctccggcaagtcaggagggaaatcgggcaaggtcaccacgcgacgtgtcaagccgaaaaacaagcctgtggatttaactaaatcctcatccgcaagcccggccggtagccataatgatctgaacattgcagacgtgcatgtcggcgacaagcttacgcatgatcatttcgggttgggtacggtcattgaaacgcaggacaagggcatgaattcggtcattaccgttgattttggcaatggtgaggtcaagcgtctgctgttgcgtatggcacccattgaaatgctatgacggagatgaagaacggatgaaatctcctctgtagcacgaaaaggaggaaaaaacaagactttctttttcaaaaagaccctgcaataatcggcggtgtttgtcttttttgagaggaagctatgaataagaaactgtacgcaggcatttcgcagatcgtgctcggcatcttgatcgccatcgcgccgcagaccttcgctcacgtatgcgcggtcaaagaaacgccgatggcatgtcattacacggctcaggccgcgctcggcatcggcatcgtgatcgtggcgcttggcattgtcggcctgctcgtatccgatcagacccgcgccggtcttgacctcgccaatgcggtgctcggcgtgctgaccatcgccgtgccgaccgtgctcatcggcgtgtgcaagggtgccatgatgcgctgccatatggtcaccttgccgacgctgatcgtgctcggcgtgctgctggctgtacttgcggcaatcgcagcatatctcgatctcaagccggcgaagcgcgcctgacccaatatgacgcaacacatcacccttggcgggttgcccctggtcaatctcaaacgcaaaccgtttcgtaccgcggcgctcaccatcgtcgtcgccatgcttaccgtggccttctatggtggttcactgctgtccatgaaccttgaagccggcttgaacagcatgcaggaacgtatgggcgccgatctcatggtcacgccgcaaaacaccaaaaacgaagccgaagcgttgctgaccaacggatcggcaagcacgttctacttcaccaacgagatcaccgacgaagtggcaaaagccgacggcatcgacgaaatcacggaacaaacatatatctcatcgttggccgccgcatgctgcgacgagaaagtccagatcatcggattcaaccccgataccgacttcgtgatcaccccttggatcgcatcgcagttcgacggtacgctccagcgcggccagatcgttgcaggagccagcatcagcgtgtcgggcaacaacacggtcaaactctatgggcacgaattccccgtggcggcgcaactcgccaataccggcacgtcgctcgacaattccgtgttcgtgaacatgcagaccgttcccgacgtggtcggatattccgccaaggtggggcatgccgccattccggaagaatatgccgacaaagccgtttccgccgtgctcatcaaggtcaaggacggttactccgcccagcaggtcgcttcgaacatcaccaaaacaacaggaatcaaaagcctcggatacgtgtatccggggggcatcacagccacaacgaaatccaatctgaacgtgatcattcgctacgtgacccttttcgtcgcggtgttctgggtcatggggctgatcgtgctgcttgctgtgttctcgtccgccatgaacgaacgcaaacgtgaattcgccgcgtatcgcattcttggtgccaatcgttccactttggtcggcatcatcgtgaaggaatcggccatgatcggagctttgggcggtgtgataggcattgcggtcgcgtcgctggcgattttcccgttcagcacgcttatcggacggcagctgcagttgccgtatctgcaaaccaacatgtggaatgtgttggcattgatcgcagtgagtttcgtgttcgcggtgcttaccggactgctcgcctccgtgacgacggcggtgaaactttccgctcccgaaacctatctgactttgagagaaggtgaatgatggcggaaaacacggttctcgaagtacaagagctcactcgcgagttcacccgtcgcggcaaaccgttcgcagccgtggaccatgtggatttcaggctgggccaaggcgagttcgtggcgatcgtcggccgttcgggcaatggcaaaagcacattgttgaatctcatcaccggactgctgaaacccacatcgggctctatcgacttggacggcaatgacgtgacgcggttgaacgacaaacaaatgtcagtcgtacgcaatcggatcgtcggattcgtcacgcaaagccagacattgctgccgaatctcacggcactcgacaatgtgattcttccttccgtgctgtgcaacggcaaaacggcgcagcgcgatgttgagatacctgcggattcgtctgatgcgaaatcagtggaagaaaccgtatccgacgcatcttccgaacagacggttgacgacggacttccggacgtcatcgcggcggctccggtatcgaaaacacacaacgatcccgttcaggaccatgccatggaacgtgcacacgcattgctgcgccgactgcaggtcgacgatttggcggaatgctacccgaaagagctttccggcggcgaaatgagacgcgtcagcatagcgcgagctctgatgaatggtccgaaacttctgatagcggacgaacccaccggagatctggatgccgaaagcactgccatcgtcatgcggctgctgcaggaagtggcgcacgacggcaccgcagtgttgatggtcacccatgatccggatgccttgacgtatgtggatcgaatctatcgcatggacaggggagtgctggctgaaccatagcggcgccatgatggcatgacatgccgaagagggcgaaacgacgagctcgtcccgccctcatgtgtattattaacgattggtgtgcgccccgcaagggagcataccgtctggagtcttagcccatcagtgggtcggcgaccgatacgagctgtttacggcacgtgttcaagtcgttcgtgcgcatgcacgaagaagcactggagaggctggctcagcgcatatcggaaaccggtgtgcgctccgttcagacaacgacagaacaaacaaaggattaaaccaatgacgaacgttcagcgttctcgccgtcaggtgcgcctttcccgcgccctcggcatcgctctgacccctaaggctcagcgcatcttcgaaaagcgtccgtacgctccgggtgagcacggccgcacccgccgtcgcactgagtccgattacgcagtgcgtctgcgcgaaaagcagcgtcttcgcgctcagtatggcatctctgagaagcagcttcgcgccgcttacgagaagggcacccacaccgccggccagaccggtaacgccatgctgatcgatctcgagacccgtctcgacgccctggtcctgcgtgcaggcttcgcccgcaccaccgctcaggcacgtcagttcgtggttcaccgccacatcctcgttgacggcaacatcgtcgaccgcccgtcctaccgcgtcaagcctggccagaccattcaggtcaaggccaagagccagaccatggttccgttccagattgcggccgaaggcactcaccgcgatgtgctgccgccggttccgggctatctggacgtcaacctgccttccctgaaggccaccctgactcgcaagcctgaagccgaggaaatcccggtgcaggtcaacatccagtacgtggtcgaattctacgcccgctgatctggatctacatactgtaagaacatacagtataaggacatacagcaagagcctcgcaatcgtcaggattgcgaggctcttcgctatctcaagcgcatgtgcggcctttttgagcaacgggaagccttcagtcgccgatgatgccgcctactatgccgctcacaatcgtcataacaagtgagccaagcacagaccatgcgaatccgtcaatagtgacgcccacagagaaaaacgacagcgccaaccatgacgcaagctgcatgaacagccaattgatcaccagtgcgaccagtccgaacgaaataatcgagaacggcaacgctatgacatggataatcggctttatggaagcattgataagcgccatgaacaaggcgaacgccgcgatgccaagcacggggggctcgccaatggcgtgcatgccgggcagaaccgcaaccataacgcccgccgcgacggtaagaattagccaacgtgaaataaaatgacccataacaacatcgtatagcacggatttgctcaaaccgtgagggtagcatggaacccatgttacttcatcttcatcttgtccgacacgggcagacgtttttcaaccgatataacaggttgcagggctggtctaattctccattgacggaatccggcatcgccgacgcagacaaagccgcaaacaaactgaaggagtttgatttcgccgcggcatattgctccgacaccacgcgtgcgcaaatgacagcccagcgcatcctcgacgtgaatgaggccgcaggacacacccgcccccaactggtcagtgacatgcatttccgcgaacagttctacggctatttcgaaggccaggatatgggcgtggcgtggaccgccgcgggagggccgcacggtgcgaagaactacaacgacatcgtcgcaaagttcggtcttggtgcgacccgcgacttccttaaggaagcggatccattccacgatgccgagtccgacgtggaatattggtcgagagtcgaggagggattcgcgctgatcgcttcgaatcctgcgctgagggacagtgatgacgtgttgcagatttcccacggcaacacgctgctgagccttatgcaccgtttcgcgccggaaggctatgacctcagcgaacgccctgcgaacggatcggtcaccacgctcgatttcgacaccagtaagcctatcgctgaagcggtaaccgtcgtatcgtataaccagtgaccggcggacgaaacttgccttaggtctgggctttttactactgttatgcgcgtgttgtgttcgcgggcaaccgtgggactgaaaagaggtacaagatgggtgttggagaaatcgccggtctgattgcggcaatcgctttcgcgattcttgccggtttcatgatctacccgttgattcgtctcggcaaactgttcgaccagctcgccgagacagtcaaagaaacgggagatcatgcgattcctgcgcttgatgagagtgtgaccacggtgcagcaggtcaacaagtcgctggaagacgtcaacaagatttccgcagcggcttccacaaccgccaataatgtcagcgccctgaccgatctgtatggatccttcttgggcaagccggttatcaaggttgcttccgctgcatatgccctgaaaaccaccgcgcagtccttcatgaacaagaagaacgtcaacagcaataacaagggggagtgatgttcaagcgtctcttctggatctccattggtgtgggcatcggtgcggtggcagtgaccaaagcacaggcgtacgtcaaggccaacacccctgatgcggctcgacaatttctgttcgggctggatcaagatcatgtcgccgtgcgcacccttgaaggtttgttcaatgagttcaacgaaacgcgtcgagcccgcgaggctgaacttaataccaaatacgcggataagatcagctgatcttattcccgtaacgtacgttcggacaacaatcacgaattcgtttgaaaggcactaggcctttcagcaaaaaaggagcttaatctcatatgcgcacttctgaaatcgcgaagcgctatcttgattatttcgaaaagcacggccatcttatcgtgccttcggcatcgctgatctctccaaacccgaccaccctgttcaccatcgcaggcatggtcccgttcatcccgtacctcatgggcgagcagactccgccgaagagccgcatggcatccaatcagaagtgcgtgcgtactttggatatcgacgaggtcggcaaaaccacccgtcacggcacgttcttccagatgctgggcaatttctcctttggtgattacttcaaggaagaagccatccactatgcgtatgagctgctgaccaccccgcaagacaagggcggctacggcttcgatccggagaagctgtggatgaccaccttcaccgacgacgaggaagcccgttcaatgtggaagaacgagggcgttgaccccgaacacatccagatcatgggcatggaggacaacttctggaccaccggcggccctggccctggcggtccgtgctccgagatctacgtggatcgcggacctgaatacggtgtggaaggcggcccgatcgccgacgagaaccgttacatcgaaatctgggatctcgtgttcgaaaactacgaggtcgacaatgtcaagtccaagaccgacctgcacatcgttggcgagctcgagaacaagaacatcgataccggtgccggcttggagcgtcttgcctatctgatgcagggtaagcagaacatctatgagaccgacgaggtcttcccggtcatcgaagccgcccagaagctgtccggccgcacgtatggcgatgacgaagccatggatgtgcgtttccgcatcgtggctgaccatgtgcgttccgcattgatgatcatgtccgatggcgtacgtccgtccaacaacggtcgcggctacgtgctgcgccgactgcttcgccgcacagtcaaggccatgcgcgagctcggcgtgaccgatccggtcatgccgaccctgctgccgacctccaaggcagctatggagccgagctatccggaactcaacgacaccttccacgatgtgtccgaagccgcatatggtgaagaggacgcgttccgtcgcacgctggaatccggcaccgagattttcgacctcgctgtggccaaggccaaggaatccggatccgacgccgtttccggcgaagatgcgttcaagctgcacgacacctacggcttcccgattgagatcaccctcgaaatggccgccgatcagggcgtcaaggtcgatgaggcgaagttccgcgagctcatggccgagcagaagagccgtgcccgtgcagatgccctgaagaagcgtcacaatgtggatctgtcggtctatgacgatttcaagaagacgctggtccagcccatcgacttccttggttacaccgacatgtccgcccgcgccaaggtgctgggcatcatgcaggaaggcaagggctccgtccccgcagtcaccggtccggccaccgtcgaagtcattctcgaccgcactccgttctatgcgcaggccggtggccagctcgccgatcagggcgagatcctttccgacgatggtgctgtgctcgaagtcgacgatgtgcagaagccgatcaaggacctcatcgtgcaccagtgccgtctgaccgaaggcacgttggttgtcggcgccgaagtcaacgccaacatcgaccttgaccgacgcggtgccatcgcccgcgcgcataccgcgacccacatggtgcacaaggcgctgcgtgaggagcttggcccgcaggccacccagcgcggctctgaagacgcgccgaaccgtttgcgtttcgacttccaatggtccagcgccccgagcaaggatgcgatgaactccgtcgaggcgcgtgtcaacgagaagctgcgcgaaaaccttgccgtcaccacgcaggagatgaagttcgacgacgccatcgccttgggtgccatgcacctgttcggcgagaagtatggcgacgtcgtgcgcgtggtctccatcggcgaagatggatggagccgtgagctttgtggtggtacccatatcgaccatgtgggcaagatcggtgccatcaacatcatgtccgaagcctccatcggctccggcgtgcgtcgtgtcgatgcggttgtgggcgaaagcgcttatgagttcaacgctcgcgagcatgcgctggtctcacagctttccgacatggtcaatgcccgtccggacgagcttgccgaccgtgtgaacgcactgcttgccaggctcaaggaatccgaccgtcgtcttgcgaccatgtacgaatcccagcttgcggcttccgtgcctgctttggtttccgaaaccaaggcatcccaggctccggtcaaggtggcagcgaagaacgtcgagcacttcggctctttcgacgcgctgcgcaagaccgtgctggatgtgcgcggacagcttggtgaggaattcccggttgtggtggctctcgccggtgtgaacgaggaaggcaagcctatggttgccgtggccactaacgaggctgcacgcaagcagggtatcaaggccggcgatttggttcgtggcgcttccaagatccttggcggtggtggcggcggcaagccggacttcgcccagggtggcggcgcggatgccaccaagatcaatgaggcgcttgaggctttggccaatcaggccatgaagggctgaaccaccaagcatggtttggcttggcattgatttaggtgatgccagggttggactcgcactgtctgatcctggcatcactcttgcacaccccgcaggcaatattcaggtctacggggattcgttccgtgcattggacgaggtcgtggacgtcatcgaagacgaatcggtcgaccatgtggtagtcggattgccgttgctactaagcggagaagaaggcaaaagcgcgaaaaaagcacggcgatggactgttaatcttgagaagagactgcgtgtcgcagtagatgatgagaactatgcgctaaaggaagtgccgtccatcgaattggtggatgagcgtctaactacggtgactgcacatcatcagctattcgatgcgcaggtcggtggacgaaagcaccgtccgatggtcgaccagcagtctgcagtggtgatattgcagacggccatcgaccgaagagagagaccagaggagagaggcctgtgactgataatctcgacgattttttctccgataacgcgcaatgggtgaattcgtcggatgatgcatccttcgtttcggcaatgcctccgcaaccaccgaaatcacgtaaggacatgcgtcgtcaccgtgagcagaagcgtcgtcgccgctatatcaccattatcgccgctctggtggtgatcgtgctgatcggtgtcggcggattcttcggcgtgcgcgcgctgaaacattggaaggccgtgaacgaagcgaattctcaaagccaaatcgaggattacacgggcccaggcgataaaggcgtgacgtttgtcgtggaatccgggcagggagccgcggaaatcgcggacaaccttgttaaggctaaaatcgtcaaatccgcagccgctttcacttccgcagtaagcggagctggcgccacgttgtatccgggatcatacgcattgaggacgcatatgagggcgtccgatgtggtcaaggtgctttctgaccaaagccaggccggcggttttgccgaagtgcgtgcgggtgaacgtgtgtcggacgtcatcgaaaatgcggcgagtgtgtccggcttggatgtttcacagttccaagccgtgatggacggtggcggtgctggaatccttcctgacgaggccggcggcaaattcgagggatggcttgaaccaggcagctacaatgtgcaaaacaagtcagcggaagacatcatcaaggaaatggtcgacgcgcgagtgagcaaactcgattccttgggcgtacctacaggcagcgaacgtgagcgcatcctgaatatcgcatccatcgcggaggcggaagtcggcagcgaaaaatactacggccaggtggcaagagtgattctcaaccgtcttgacgccgatatggctctcggcatggataccacggtcgcctacggtcttggtatttccgcaagccagttgaccgatgaccagttgggcgatgacagcaacgcgtacaacaccagaatccacaagggactgccgcccacgccaatcagcaaccctggagatggcgcgatcacagcagccgtcaatcctccggacggcaagtggctgtactttgtcaccacaaacctgcagaccggcgaaacgaaattcgtggaaaccgaagatgagttctggcagattcgcgacgagtacaagaacaacaacgagaacgcgaactgatctcagaataaaacgccaatcgcaatgcctatcgccccagctgccacaagcgctggggcgataggcgttttaccggcatatgcggtatgcttctgcggatcgaaacgtgtccacaaaacgagccataacaagccgaccacaccaatcgcaagccaccaaaacaccacggcgaacagaccgaacatgccgactgccaatcccatcagcaaggtggcggtgacatcgccaaaacccaatgaaccaggtttcaccaaagcgagcgcgcattgcagtacggccgacagtacggcgaagagtattgcctgcaatgccaggtacagagtgttgatggaaagtgcgtatatgaggtttacgatgatttgcgctgtgcatccggtggcgatccaggcgcgtggaatgcggcgtgaacggatgtcttcaacgctgatggccagtccacaaagcagacttggcaggcaaatcatataccacataccgttaagatagtccactagttgcattcgtgagaaaaggagttggcatgttgcgttggcagacagcaggcgagtcgcatggtgaggcgcttgtcgccatgattgaaggattgcccgcgggcgttcatatcaccacggaggatattgttggcgcgttggcgcgtcgtcgtcttgggtatggtcgtggcgcgcgtatgaagttcgagcaggacaaggttcgtatgctgactggtgtgcgttttggtgagacgattggttctccggtggccattgagatcgccaacaccgagtggccgaagtggactgaggtgatgagtgcggatccgcttgatcatgagcttgctcgtgagggccgcaatgccccgttgtctcgcccgcgtccggggcatgcggatttgactggcatgcgtaagtatggttttgatgatgctcgtccggtgttggagcgttcttccgcgcgtgagacggcttcgcgtgtggcgttgggtgaggttgccaagcagttcttggagcaggcgttcggtattcgtaccgtttcgcatgtgctttccattggtggcgcaggtattaccgatccgcagcaggccacgcttcccaagccggaggatcttgaggcgttggacgcttctccggtgcgcactcttgacaagaatgcggaagagcggatgattgcccgtattgatgaggcgaaggagaacgccgatacgttgggcggtgtgatcgaggttgtggtgtacggcgttcccgcaggcgtgggcacgtatgttgaatcggatcgtcgtcttgatgctgctcttgccagtgcggtgatgggtattcaggccatcaagggcgtggagatcggtgatggtttccttgaggccatgcgtccgggttctcaggctcatgacgaaatggtggtgggcgatgacggccgtattgcgcgtctaagcaaccgtgcgggtggtatcgagggtggcatgtcgaatgggcagccgatcgtcgtacgtgcggcgatgaagccgattccttccattccgaaggcgttgcgtaccgtcgatgtgaccacgggcgagccggcgcaggccattaaccagcgttccgacaatactgcggttccggcggcggctgttgttgccgaggcgatggtgcgtttgaccatcgcgcagtatgtgcttgagaagtttggcggcgattgcgttgccgaaaccaagcgtaacgccgagcagtacgttgcctcatggcctgagcatatgaggtgattcgtctatgagtggtatgcgtaggcctgtcgccgtgatcatcggcatgatgggggcgggcaagactcgtgtcggcaaggaagtggcgcagatgatgaatctgccgttcgccgatgcggacaatgagattgagcatgatgccggaatgcggattcccgagtacttcgaaaagtatggggaaccggaattccggaggctggaaagcgacgtcgtgcttgatatgctcgaggatttcgacggtatcttttccttgggtgggggagcgccgatgacgccttccattcaggaaggattggcgcagtatatcgcggacggtggcaaggtcgtgtatcttatggccgatcctgaggaagccatggagcgggcaaatcgcggtggaggccgtccgatgcttaatggcgatgccaatgagcgttggaagaagctctacaaggaacgtgacccggtgttcaggagcgtggcgaacgtgcatgtgggcacgcgtggccagtctccccaagccgcggcgagaaagctgatggaaatgattgatcaacgtatagtccatgtcaccggttccaccatcgaaccatacgatgttcgtatcggagagggtgtgatgggccagcttgcgcaggtgttgggaagcaagcctgccaaagtggcgcttatccacacccagccggtgcagcgtcattcggaccgtgcgcgtactttgttgcgtcaggcgggctatgatgcgtacgatattgtgattcccgacgcggaggccggcaagaccattgaagtggccaatggtatctggcagcgtttgggggatgagggtttcactcgttctgacgcgatcgtcggccttggtggcggcgcggcaaccgatttggcggggtttgtggctgccacatggatgcgtggcattcgctacgtgaactgcccgacgtcgttgctggccatggttgacgcttcgaccggcggtaaaaccggcatcaatacccctcaggggaagaacctggtcggctctttctatacgcctgccggagtgcttgccgatctgaaatcgcttgcgtcactgccgaacgacatcttcatcgaaggattgggcgaggtcgccaagtccggtttcatcatggacccggagattctgcagatcctcgaggaccatgccggtgaattgcgtgccttcgacgggtcgacgttcttggattccggcctgaaggatgtggtcgcggagctgatcgaacataccgtgagcgtgaaggcctaccatgtgtccgctgaccttaaagaggcgggattgcgcgaattcctcaactatgggcatacgctcggtcatgccatcgagaagcttgagcatttccgctggcgtcatggtaatgcggtggcggtcggttgcgtgtatgcggccgaactgtcgcatcttctggggtacatcgatcaggatctcgtggactatcatcgttcgttgttgggatctctggggctgcctacgttctggaacaatggcacatgggatgatgtgctcgcattgatgcaccgggataagaaggctcgcggcaataagcttcgtttcgtggtgcttgagggcgtcggccatccgattcatcttgaggatccgcctgcggacgccgttgaagaggcgttccgtcgtattcagcagtaaacaaggtagggaagtggaatatgactaaagtagtggtcgtcaatgggccgaatcttggtcgtcttggcgtgcgtcagcctgacgtgtatggcaagcaggatcttgaaaccctgcgtaccctgtgcgcgcagtggggcagcgagcttggtcttgacgtggaagtgcgtcaaagcgatgacgaagccgagatgatcggctggatgcaccaggccgccgacgagaagaccccggtcgtgatgaatccggcggctttcacccattactcctacggtctggccgatgccgcgcatatggtgatcgatgagggattgccgctgatggaggttcacatctccaatccatccgcacgcgacgaatttcgcaagcgttccgtgatctcgccagtagcgacgggcactatcaccggtatggggttctatggctacaagctggcgttggatgcggtggcgcatctgttggaatcgaagtgatgattttccgatttccccttgagatagtctcggaggaactatgaatgccggatgctcttgatgggcatccggttttacatagcattgcattcgtttgcagaaaaagctgcaacaatcgcaaatatgattgccgttttgcgcaacacaatgaattgttgctgaaagcattttctttcgcttgtccttcttttccgtatattgcaatcggtcacgctgtttcattgcgatgcgcagcatctactgtacgatgaaccccgatctagggtgcaaacgtatgcacattcatcgcagagtgtgtcttagatgatccgcaggtaacgcggatgaccatggcgcatacgttgtcgaagggcggaacctgccatgggggccggaattcgatctcaacgatgagaacggagaacaatggtcgttcagcgaatgaatcggccggctagccgtgcggtggccataggcgtcgccgccgccatggcgtgcgccaccttggtggcggtaccgcatatggctcaggctcagcccgaggcgcaaacgaatgcgaagaaagacgtgcaggtcatcgccttccagcagacatggaacacggtcgccaaggaatgcacgagcacatacggtccggaaggcgtggcatacgtcgaggtgtcgccgccgcaggaatccatccaaggcacgcaatggtggacgtcctaccagccggtaagctacaagctcgattccaagctcggcacggaagccgaattcaaaaacatgatcaagcagtgcaatgccgtcggcgttgacatcatcgccgacgttgtgctgaaccagaccaccggtgccgacgtggccgacggcaagcagaccggcgtcgcaggaaccgaatacaacggttcgaccggcgactacccgggatttgccaccgaacagtatccggaaggcatcacggcctccgacttccacagctgctccaagaacatctccaactacgccaaccagcaggaagtccaggaatgccgcctgagctccatgtgggacttcgactccgagagcgaaaaggtccaggatattcaatctgactatcttgccgccctgtggaatgctggtgttcgcggcttccgtatggatgccgtcaagcacatccacacggacagcatgaaggccatcaaggagaagttcgcaaagaagatcggcgtgaatgccgacagcatctactggatccaggaggtcatcgggaactcctccgaagccgcgggcatccagccgagcaactacgtgcaaaacggcacggtgaccgaattcggcttcaagtccgaaatgaaccagaccttcaaagacaagatcgcaaacctcaagggacttaatgagcggttgagcaaggatctcgcctccgaagacgccaacgtgttcgtcaccaactgggacaccgcgcgcaacgagggcgccctgacctacaaggacggtgccaagtatcagctggccaacgcattcatgcttgcctacgactacggcacgccgcgtctgctttccgactacaagtgggatgagaacgacaacggcgcaccgggagccaccgccacatccgttccggacgtgaacatggacgaggtctgttccaccaacagctccgactggaactgcgagcagcgctggacctccacccgaggcatgatcgccttccgcaactacgtcaacggcaccaaggtcgccgactggcaggatgacggcggcgacaacatcgccttctcccgcggggataagggcttcatcgccatcaacaacggcaagaccgacaaggacgcctcctacacgacatcgctcgccgacggcgaatactgcaacgtgtacgccaccatggactgctcccagactgtaagcgtcaagaacggcaaggtcgagaccacggtaccggcgcattccgccatcgcactgtatgcaggcgccaccaaggacagccacccggcatccagcgtggccaacgacccgtccgatcctgacgtgaaccaggaaggggacgagaccctgcccgacgacagaagcgtcaccatctactacaagcccgccgattccagctggaagagcccgaaggtccactacggtcttggcgatgactggaaccagccggaagccgacatgaccctcgacgagcaggggtactatcgcgccaccatcgacaccaggggcaagaagatcgacttcgtgtttcacgataccggcaccgaccagtgggagaacccgaagggcggcggcaactaccacgccaacgcgggcatcacgcacgtgggtgtggccgatcaggccgcgaccgtgggtaatccggaatccgtcaacggccagacccgactcgtcgtgcactacaagccagccagcgattccgataatcgcggcgtgtacgtgtggggcacagacgctggcggctcgagcctctcggcagtcaaccatcccttcaccggagctgactgctggggcaaggtggctacgctgaccttcggcggcaagttcgacaagttcggcttcatcgtcaccaccgcagactggaacaagtacggtggcgaccgtagcgccacggtgaacgccgacggcacagccgaagtgtggatcgacggcaccaaatatgaggatcaaggcgaatcgaccaccgtcgaaaccctcgactccgctccgagcgactacgaatgcaaggccaacaccgttaccgtgaaggtccactacaaccgtgatgacggcctgtactacaacgccgaagacacctcggtcaccgttccccagtgggacatctggacctgggcttccaattggaacggcggagccgccaccttcaccacccacgatgactggggcgaggtcgcggaatactccttcaccaactacacctactacaacgtcgacggagcctccgacatcggcatgctgcgccgttacggaaaggatgcgtggaaggccaaggatccggatgacgccgattacaagatcccgtcaaacgccttggtgttcaacgaatcggacggcaccgcatcggccgaagtgtggctgatgggcggcgacgccaccgtgtattcctcacgtccatcgttgggagcgtccatgaagtccgttgaaatctccgacgtcaacaagctgaccgcaagactgtccaaaaaggtcacttcggatgagcttgaaggcaaggtctccgtcactgacgccgacggcaaggctgtagatgtcaagaacatcaagaccgacggcaccaaggtgatcatcaccacggccaaggatcttgacatgcgaggcaagtacaccgtcgaagtcaagggcttcggttcgcaggacgccattgcgggctcggtggtgcgtacggatgccttcgacaagaagtacgcctatgacggcgacgatctgggcgccacttacatgagcgcgaagaccggattcaaggtgtgggctccaaccgccaccaaggttgagcttgtcacctaccagtccgacgatgtgaatgccgaagtcgacaagaccatcgacatggcctctgaagacaagggtgtgtggagcgccctggtgaagaaccttgctagcggcacggcctactcctacaagctcaccttcgcggacggcacggtgaacgtctccgccgacccgtacgcgaccgctgcggtcgccaacggcgaacgttccgtggtgctctccagcgaagacatgggctccgcaggcgaccgcatgccggaattcggcaagaccactgacgccaccatcgccgaaatgaacattcgcgacttctccatcaacccgaattccggaatctcagccgacaagcggggcaagtatctgggtgttgtggaatccggaacgaagacggcgaacggcgccacctccggtcttgactatctcaagcagttgggcgtcagccacgtgcagatcatgccgatgtacgactacggttccgttgatgagaccggcgatctgagctacaacgcgcaaggtgcgcagaactggggctacgatccggagaactacaacgtgccggaaggctcgtattcctccgatccatccgaccccgcctctcgtgtcaccgaaatgaagcagatggtcaagggactgcacgagaatgacattcgcgtgatcatggatgtggtgtacaaccacgtctacgatgccgccaaccactcgttcaacaagaccgttcccggctactacttccgttatgatgacaacggttccctggtcaacaactccggctgcggcaacgatacggcctccgagcgcaagatgatgcgcaagtacatcgtcgattcggtgacgtattgggcgaagaactacaacgtcgacggcttccgattcgatctcatgggtctgatcgacaccgaaacgatgaaggaagtgcgtgcagcgctcgacgagatcgacccgtccatcatcatcctcggcgaaggctgggatatgaacaccactatggacgagggcgagatgaccatccagccgaacgcgtaccaagtcgcgtccgacggcacgaacaacggcatcgcgttcttcaacgattccgtgcgtgacggcttgaagggatccgtgttctccgacaccgacaccggtttcgtttccggcaaggccgaccaggagagcctgatcgcccacaacgtgctcggctgccagtacgacgagaacgcgaccacgacctgctggaacggcaacgcgcaggatcactacgccgatgccggacaggtggtcaactatgccgaaatccacgacaacatgaccctgtacgacaagctcaggaagtccgtcccgacggatgacgacgccacgaccgtggcacgtgccaagcttgccgactccgtcgtgtatctgtcggaaggcatccccgcgatccagctcggccaagagttcctgcgcaccaagggcggagacggcaacagctacaacacgggcgacgcggtgaacgccatcgattgggaccgcaccacccagtacgccgattccgtcgactacgtcaagggcctgatcaagctgcgcaagcagatcaacgcgctgcgtctgaccgactacaacgacatcaacgccaacgtgacgatgctcaagtccgctgacggcgtcgtggcctaccaggccgagcagtccgacggcacctacgtggtgatcttcaacgccaacgcagacaagaccgcgatcgaaggcttggcaaacggctcctaccaagtgcttgcagccgacggcaaggtctactccgatgatgctatcgccaatgtcgatctcgccgaaggggcctcgtacgaagcgggcgcactgtctgccactgtgctgaaactcgacagcagcaccaagcccgataccgacagcgcgcctgtcatcaagggtctggtggcttccgacagcgtgactctgggatcaaagttcgatccgatgtccggcgtcagcgcatgggatgaggttgacggcgatctgaccgacaagatcacggtcgaaggttcggtcgatacctctaaggaaggcgaatacacgctcgtgtactcggtgaccaacagcaggggcaagaccgccaccttcacgcgtacggtaaccgtgcgcaaacccgcggtccagccagcttccgacaagaagagcgatgctgtgcaaagcccgaatactggttccgccatcaccggtttcgcactggccgcggtggctcttgccatcgcatccgtgttcgcgttcgcggcctcccgcagaaaggaggactgatctcataagccaatgattgactgaatgtatctcctattcctgctaggcggggccatcaaggcaatgatggccccgcctttttgtattgaaggaaacacgccgcgtctcatgccgctgatagactgaagttccatggttagaagacaacatggcaattctcaagagcacgttaccaagcatattttcgtcaccggtggcgtcgtttcctctctcggcaaaggcctgaccgcctcctccctcggccgcctgcttcgtagccgcggcatcaaggttttgcagcagaagctcgatccgtacatcaacgtggatccgggcacgatgaatccattccagcatggtgaagtctatgtcaccgaagacggtgccgaaaccgatctcgacatcggccactatgagcgtttccttgacgtgtacctgagccagaaggcaaacgtcaccaccggccagatctaccaggaagtgctgcgcaaggaacgcgccggcgaataccttggacaatgcgtgcaggtcatcccgcacatcaccaacgaaatcaagtcccgcatgcgtgcgcaggcgtccgatgacgtcgacgtgatcatcaccgaaatcggtggcaccgtcggcgatatcgaatcccagccgttcctggaggccgcgcgtgaggtccgccgcgatctgggcgccgagaactgcatgttcgtgcacgtctccttggtaccgtacattgccgccgcccatgagctcaagaccaagccgacccagcactccgtcatgatgctgcgtcagctgggcatctccccggacgcgctggtgcttcgttccgaccgcccgctgaaccagtccatcaaggacaagatctccctgatgtgcgacgtggattccgaaggcgtggtcaactgtgtggacgccccgagcatctatgacgtgccgaagaccctgttcgacgaaggcctcgacgcctatgtcgtgcgcgagctcggcctgccgttccacgatgtcgattgggacgagtgggaggacctgctggagcgtgtgcaccacccgaagcatgaggtgaacatcgccatcgtcggcaagtacatcgatttgccggatgcctacctgtccgtcaccgaagccatcaaggccggtggtttcgccaactatgccaaggtgaacgtcaagtgggtcgccgccgataagtgcgagaccgaggagggcgcggccgccgcgctcgaccaggtcgacggcatcgtcgttcccggaggcttcggcatccgtggcatcgacggcaagatcggtgccctgaagttcgcccgtgagaacaagctgccggccctcggcctgtgcctcggcctgcagtccatggtcatcgaatacgcccgccacgtcctcggcttggaggacgcgaactccaccgagttcgagcccgattgcgcgaccccagtcatcgcaaccatggaggagcagaaagacatcgtcgccggcaatggtgacatgggacacaccatgcgtcttggctcctatccggctgagcttgaagaaggttccatcgtcgcggaactgtacggcaccacgcatgtcactgaacgtcatcgtcaccgttacgaagtgaacgtggcatataaggaccgtctgcgtgaagcgggtctgcgcatttccggccagagtccggacggcgaactcaccgagttcgtcgagcttcctcgcgaggtgcacccgttctatgtgtccactcaggctcatcctgagttcaagtcccgcccgaccaagccgcacccactgttcgcaggtctggtcaaggccgctctggaccaccagcaggagcgctaaatcgacgaattgtgattaacgtcggataacccgatatgcaacatggtcatgagtccaaaggagttcatggccatgttgcataataagggcttggccttgaattatcaacaagacgtattcgtaatgaaaaacctttacgagggagcatgagcttgaacgatatggattctccggaaagcggcaacggtaagttcgccttcccgaacatgggcgatgaaccaaaagtcatctcgcaggtgagcttggattcgtttgccgaaacggccgatcccattgatgatggtgcagcgttgactgtgaatgccagcaagaagcgccacctgttgtggctgtggattgttcttgtggtgatgcttcttctcggtgccgtggccggcggcggatactggttcttccagtcacatgcgttgccaggtgtcacgctctggggcaagtccatgacaggacaatcccgagatcatatcatccaagagatttccgatacggcggaatcattaacggttcccgtttcctatgagggaacgagcaagaaagtcacgttgaaggatcttggcgtcgccattgacgcggaatccatcgccgaaaatgtgatgaacgcgaaacgtgacgattccttctttcagaagtatgcattctggacccgtgaggatgtcgacgtcgagtctttcgatgattctcgagtcagcgcccagacggtaggtgacatgttgggagtgcagtccgtgtccgccaccaacccgtcgctacagctcaacgcggatggtaccgctttcgatgtgacgccaggtcagcaggggactggtatcgatgtgacggatatcgtcaaagaagccaagaacgtgcttgagtcctttggcaagcagaccgctcaaatggtgactcttaaaaataaggttactgatcccgtcatcacggatgaccaagccaacgaggccaaggcttctgctgacgcgtggatagcgaagccggtggctatcaagatcggcgaccataaagtggcggaattcggtgcgcagtccattgcatcggccatcacgcttggaccggatagtgagaagctcggcgataatcaaacccgaaatggctctttgattatcgatggtgacaaattgcagcaatactataacgattccatcaaatcgaacttccatgctgatcgagttgacggtgatgtcatcgttaatagtgtcggtgatgtgctgcaaaccaatgtagctgggcatgatggtataaccgttactgatggtagcgacaccaatgttggccgtgatgccgctgaggcgtttgccaaaggttctgattcagtaagtattcaaggcacttgcgacccacagaatgagaaaaaaaccacgcgtaccgtggtagtcagcttgtcttcgcataccgttacagccattgaaaatgggcagaccgtccgtgtcatgcatatgtctgccggtcagggcaatgattatcagacgggccagtgccagccgagcggcgacttgtgcacgccaacctactgcgatccgaactcctacgacaactgcacgcctgacggtgacttcaaagtgtggctcaagtaccagtcccaagatatgagtggcacgcttaccctatcggatggaaacaccgagaagtgggatgtcaaggatgttggattcgtcaactatttctcgaaaacaggttgcgcgattcatcgcatcgccactcaaagtgcgtttaacgacagcagtattcaggctatggggaagaacacgtcccatggttgcgtcggcgtcggctgggatcaggctgaatggttctacaattggtgcctgatgggaacgacggttcacgttcaggcctgatatgcgggctaacggcagaaagacgcaaaggcggaagactgaatgttcggtttccgcctttacgctatgtaagataaatcacgacaaatcattgccgaatagcgaaaggggcgctagtgtttagccccacgttctgttaggttgtcataggtaaaaacgagtgattggaggcagcgtacggtggcagagaaccaagcgcccaacgccgcggctgacgtggagatgagccagtatgtggctgatcgcacgcgagtgaatgaagacaagatcaagcaggatgacgaaatcatccagcagttcggcgactatacgtacggatggcatgatacggatttcgctggagaggcagcgaagaagggcattgacgagaatgtcgttcgtgccatttccgcagataagaacgagccggaatggatgctggaaaagcgattggaaggctatcgcgatttcatcaaccgtccgatgcctcaatggggtgtcgatctgaaggatttcgacgccgacgatttcaagtattacgtcaagccgatcgacaagcaggccacgacttgggaggaattgcctgacgagatccgtgcgacgtatgacaagctcggtattcccgaagcggaaaaaagccgtcttgtctccggcatcgcggcacagtacgaatccgaggtcatctacaactcaatccagaaggatcttgaagaccaaggcgtgattttcgtcgacaccgataccgcggtgcagaagtatccggaaatcgtcaagaagtatttcggcaagtgcattccgagcaacgacaacaaattctcggcattgaacaccgccgcatggtcgggcggatcgttcgtctacgtgccgaagggcgtgcatgtcgatattccgttgcaggcatacttccgtatcaatacgccgaatatgggtcagttcgagcgcacgttgatcattgccgacgagggatcgtacgtgcattatgtggaaggctgcaccgcaccgatctactcgaccgattcgttgcattccggtgtggtggagattttcgtcgagccgcatgcccgcgtgcgctacaccactgtgcagaactggtcgaacaacgtttacaatctggtgacgcagcgtgcctacgtgcgtgaaggcggcaccatggaatgggtcgatggcaacattggttccaaggcaaccatgaagtatccggcctgcattctcgccgagccgtatgcgaaggccagcaccatgtcgctcggcttcgcaggcaagggccagtatcaggacaccggcgcgaagatgatccatcttgccccgcataccagctccaccattgtggcgaagtcgatttcccgcggcggtggacgttccgcataccgtggtctcgtcaaaatcgtcaagggtgccgaaggatcgtccaactcgacggtatgcgatgcactgcttgtagatgagttcagccgctccgacacctacccgcatgtggacgtgcgcgaagatgacgtttccatggcacatgaggctacggtttccaaggtttccgaagaccagctgttctacctgatgagccgcggtctttctgaagacgaggccatgggcatgatcgtgcgaggcttcgtggagcctatcagccgtgagctgccgatggaatacgcgcttgaactgaaccgactggtggaattgcagatggaaggatcggtgggctgattaccatggcacaaactcaggaaatcaacattcccgttgcggatccgaacgatccgtatgcgaatccggcagccatgccctcttcggcggatcgctcgccgcggtcatttgatgtggacgcatttgaagtgcccgaccgcaagcaggatgattggcgttatacccctgtggaacgtgtcgaagagttcttcaacgcgttcacgccgtcgaacgaaacccagattgccgtcactatgatcgacggcacggctcttactgaaggcgtgacctatagcgagggcaagccgggagacgccgatacgggcatcgtttccaagccctgcgatcgtgtgtccgcagtggaatggaactccgcctcccgtgccggaattctgcgtatcgacggtgaaatcagccagccgatactcgttaagattcatggttccggaacggatctggacgcattccacctggtgatcattgccgccgatcgcgcccacgctgacgttgtggtagagcatgacggcgatgcacgtatcgccgaaggtgtggagattctcacaggtagggactcacatgtgtccaccacgttcattcaggagtggaacaagggctccaagcatgtgggcaaccagcgtatccacttgggggagggtgcgtccctgcgccattccgtggtcacgcttggcggcgatgtcgttcggattcgtatggatcaggattttggcggcgatcaaggcgatctcaacatgcttggcatctactttgtggatccgggcgagcatatcgaacatcgcaccatgattgtgcacaaccatcccgagtgcaagagtcgtgtggtatataaaggcgctcttgacggcaagggcgcgcactccacatgggtcggcaacgcgctgattgctccgaccgcgccgggtaccgactcgtatgagctcaaccgcaatttggtacttactccgggcgcgatcgccgattccgaaccgaatctggaaatcgaaaacggcaacatcatcggagccggacatgcctcttccgtcgggcgctttgacgatgaggagctgttctatctgcagtcccgcggcattccggaaaccgaagcccgcaaacttgtggtgcgaggcttttttggcgaactcgtcgaggaaatcggcattcccgcaatcagcgaacatctcatgaacgttatcgacaagcgcctggcacgtggcgagaacgacgcgatcgcccaggtgttggaagagaagtagaacgtaggagcgaaaaccatgtcaactcttgaaatcaaagatctgtacgcgcacgtcgaaaccaaggacggcatcaagccgatcctcaaaggcgtgaacctgaccgtcaactccggtgaaacccatgccatcatggggccgaacggatccggcaaatccacgctggcctacacgctggcgggccaccccaagtacgtggtcgattccggacaggtgctgctcgacggcgaagacatcctcaagatgaccccggacgagcgagccaaggcaggcatcttcctagccatgcagtatccggtcgaagtgccgggcgtgtcgatgaccaacttcctgcgcaccgcaaaaaccgaagtcgacggcaaggctccggccatccgcacgtggaccaaggaactgtccgaggcgatgaagcgcctgaagatggatccgaagttcgccacccgttccgtgaacgagggtttctccggcggcgagaagaagcgtgccgaagtgctgcagctcgaactgctcaagccgaagttcgccatcctcgacgaaaccgactccggccttgacgttgacgcgttgcgcattgtctccgaaggtgtgaaccgcgccaaggaagccaaccagttcggtattctcatggtcacgcactacacgcgaatcctcaagtacatcaagccggacatcgtgcatgtgttcgcagccggtcacttcgtcaagaccggcggccctgaactggccgatgagctcgaggaatccggctatgacgcatacctgccggaaggatccgattccgaaagcgcgctggcatgaccgattttgcagcgattcgcaaggaatttccgatccttgatcaggagatccacggccatccgctcgtgtatttggattccgcggcgacttctcagaagccgcaatgcgtgatcgacgccgaaagcgatttttaccgcaccatcaacgccggcgtgcatcgtggagcgcatgagcttgccgcacgcagcaccatggcgttcgaagaggcacgtgccaaagtcgcacgtcttgtcggcgccaactccgctgaaggcgaagaggagatcgttgtcacctccggcgccaccgcaggactgaatctgctagccaccgcattcggcaacgcatcgctgggacgtgggggagaagcggcacgacgtttcgctgtgaagccgggagacgaaatcgtcgtatccaaggccgaacaccactccgtgctattgccgttccaggagcttgccgtgcgtaccggagcgacattgaaatggttcgatctggacagtgaaggtcgcatcctttccaacactgcggacgaggtgatcaccgaacgcacaaagatcgtggccgtcacccatgtgggcaacaccaccggtgccatcaccgacatcgcgccgatggtgaaacgtgcgcacgaggtaggcgcggtggttgtgctcgacgcatgccagtccgtaccgcacctgaagatcgacctccacgctttggacgttgacttcgcggcatggagcgcgcataagatgtacggcccgaccggtgtcggcttcctctacggcaagcgcgacatgttggaggcgttgccaccggcgaatttcggtggatccatggtggaacttgcctggatggatcaggaagcccaatacatggctcctcctgcgcgtttcgaggcgggcacgcagccggtcgcgcaggtcgttgcggccggtgtcgcggccgaatggctgatgaatatcggcatggagaatctcgaagcccacgagcgcgttatcgcaggcgaactcctcaagatggggcagatcgacggcgtgcgcattctcggaccgcagaccaacgagcagcgcatcggcacggtggcttttgaaatcgacggcgtgcatccgcatgatgttggccagttcatcgatgcgcagggcatcgccattcgtgtcggacatcattgcgcgcagccggtccaccgtcacttcggcgtgtacgcatccaaccgcgcatccagtggcatctacaattccgtcgaagacgcgcaggcattggttgaggcgttgaagaaggtccgtccgttttttggagttgagtaacgcatatgagtgattttgcaatgtctggcgacgatctcgagcagatgtaccaagaggtcattctcgaagcctcgaagaatccgcatggcaaggagcatttcgctccggatctggcttccgaaaacgcctcccaggcgggaaagaccacggttcaggcaacccacgagtattgcactcccggcgagtcccaccagttcaatccgacctgcggagacgaggccaccgtgcatgtggaggtttccgaccaggagccgcacgttatcgaacgactggtgtgggacggtcacggctgctccatttcacaggccagcctttcggtgatggtggatctggtggaaggcaaaaccgtggatgaggccatggaattggccggaacgttccataagctcatggaatcacgcggcaaaggcttggacgatgaatccgccgaggaatcgttggaagacggcatcgtgttccaaggagtgtccaagtatccaatgcgtatcaagtgcgcgctgctcggatgggaaggcatgaaggactccgtggccaaggcattggccgcgaaagcctgacaagtattgttctatggtggaaagcaggatgtctcccgtgcttcgtgcgccgcgttctacaacgggcgaaacacgtgagacaaactccagccaacgcgataggctactcaacggaacatattcgaatcatatatggagcgacaatgagcgataccttggtacctgaaccgcaagcctcgattttcgattccgtggccaaggcattgggcaatgacgaggccgcggcgcgtcgcgtcatgcttaacccaaatctcgccaaaggattcaaggacggcaaaccagtggaaatcgaacacgaagacaccaagcaggacgcttgtggctgcggcaatcaggctggagcatgcggttgttccgaagaacaggatgacggcatcgcgttgaaggctattgacgacattggtcgagctactgcggccgacgtgaaggaagcgttgcatcaggtcattgatcctgaacttggcattgatgtgattgatttgggattggtgtatggcattgagatcgatgagcttggtcgtgccattatcacgatgacattgaccactccggcatgcccgttgactgatctgatcgaagacgagtgcgcgagcacgcttgccggcctcgtcgaggaattccgcatcgactggacgtggcaaccgcgttggagcatggaaaagatcacgccggaaggtcgcgagcagttggctgcgctcggcttcaatttcgacaatctgccaaaatactgacagaaaatctgtgatatatcaacctgatattgctgatatgttgattccgcagcgaaactgcatgttcgttgcggaatttttttgtaaaacagattttgatgatatttgattggatatcatcatcaagaaaaaatggcacagaaaaagcgtgctcccgacgccgggaagcacgcttttgttctgtgtgcggcagaacgtcagtcgtcgaccacggtacccttcggcaccacggtgatgccttccggcgtgacggtgaagccacgggccagatcatgttcggtatcgataccgacggtcgaattctcggtaagcacaacattcttgtcgaggatcgccttgtagacgcgtgctcgacgattgatggtcacgccgtcgaacagaatcgaatcgacgacctgggaccacgagtggatacgcacgttcggcgaaagcacggaatgatgcacttcaccgcccgatacgatgacgccaggggagacgatcgagtcggtggcgtgtccgagacggtcgcgaccggcatggacgaacttcgctggcggcagattgccggacagcgtgtaaatcggccattcggtgttgtacaggttgaattccggcacatacgagatcagatccatatgcgcatcgtagaactgcttcagagtacccacgtcgcgccagtaggcatgatcggtcggcgtcgctcccggaatctcgttggagttgaagtcgtacacgccagcctcgttacgggccgcgaagtacggtgcgatatcgccgcccatatcatgcttggtgtcttcggccttctcgtcaagcgccaaagcttcgaacagggcgtcggtgttggccacgtagttgcccatggaagcaagaatggagttcggatcatctggcaggccggtcgtggtctgcggcttctcctggaagctcttgatcatattcgggtgctccggatcaacctcgatcacgccgaactggttggactggctgatcggctggcgaatacccgccaccgtgaactccgcgccggattcgatatgctgctgcaccatctgttggaaatccatgcggtagacgtggtcggcgccgacgatcaccacaatatccggctgcacgtcctcgatgatgttgatggtctggtagatggcgtcggcagagccgagataccagtgcttgccaagtcgctgctgagccggaacaggggagacgtagttgccgagcaacggcgaaaaacgccacaccgtggaaatatgacggtcaagcgaatgggacttgtactgggtgagcaccacggtctgcatatagcctgaattgaccaaattgctcagcgggaaatcaatcagacggaacacgccgccgaacgggacggcgggctttgcccggtctctggtcaaaggcatcagacgagtgccttcgcctcctgcaagcacgatggaaagaattttcggattctttgccatgagaactcctctcctagagcgtcgttacgacaccgcacacattggtcggtctgcatcatcgcaaaccacttacgcactcaataattgcatattttctgcaacatgcaaggagtttgcatcgcgagtcttgaaaatttgctgactgtttcagtgaacagctgttgaatagaaggccacggcgctcgatgcggcgacgttaagactgtccactccgtggctcatgggaatcttgaccgtcaggtcggcgcgggagatggtgtgatgcgacagaccgtcgccttcggtgccgaaaatcagcgccaatttgtcgatatggtccttttcgccgttgtcgttgttcaaacgacgaacaagctcctccagcgaaatggaatcgtcttcaagggccatcgcaacggtggtgaacccaagatcgcgcaattcctgcatgccggtgaatggccagtagtgtttatcatctccgccgatacgagtccacggaatctgaaacaccgtgcccatcgacacgcgggcggcgcgtcgatacaatggatcgccgcaggagggcgtcaccaacactgcatcgacgttcaacgcggcggctgatcgcatgagggctccgacattggtgtggtcaacgatgttttccatgaccgcgatgcgtcgtgcgccgcgacacacctcctcgacgctgggcagtggccagcgtttcatcgcggccagggcgccgcgatgcaagcggtagccggtcagctgcttgagctgttcaggggatgccacgtacacgggaatgtcggtgccccaacgttggtcgatgcgtgcgaaggtttccgacatgcctccgatccacggttcttcgacaagcagggaaatcggttcccggtcggcggtcagcgcgcgatcgatgactttcggcgattccgcgatgaacaggcccttgctgggttcaagcttgttgcgaagctggatttccgtgagattcgtgtatgccgacacgcgctcgtcgtcaatggaatcaagatggatgaactgcatgtgatcgatctttcgccgaatagctttcagatacaagaaaaccccttgtttccaaggggtttgctggtgtccggagcgggacttgaacccgcacgcctgtataaataggcactagcacctcaagctagcgcgtctaccattccgccacccggacaggtgcgttgctcagcggcaacaaacgaaaactatagcagatgctcggtgtgatgcaagtctcggcgtgtcgcgcggaattacgccattggtatccgaggtgctggtaggctctgaaactatgactgatgcccttttcctgcttgatacggaacatgatgatgtgccggtgaacagtgacgaattgaacgccggatggaaattgacgttgccccagtcggtgcgtcgacatgccattcaggccatgcgtctgaaagacggtgacgaattgcagctttccgacggtaaagggctacgtatccacgcggtgttgcgcgatgcgcaacaaggaatcgcggaagtgtcgagcttcggcaaagaaccgcagcctaccaccaaactcgctttgatccaagcgctggcgaaaacaggacacgatgagcaggccatcgacaccgcaacgcagatcggtgtggatgaggtgattccatggcaggctgatcgttccatcgccaaatggaaggcggggcgcaccgataagaagtggcggcaagtgcttgatgccgccactgaacaatcccgacgctcctggacgccggaattgggggagtgcgtgaccagcaagcagttgattgccatttgcaagcgtgcctgtgtgcacggcgacatggtgattgtgctgcaccaggatgctaccaaaacttggagccagctggaggaagcgatcgcggtgctttccgacaaatgcttgcaggacgggcgccagcgcaccgtgtacgtggtggtcggcccggaaggcggcatcagcgatgctgaaatcgaatccttcaccaatgcgggagctgaagcatgcgtgcttggaagcaatattctgcgagcatcgacagctggtcccgtcgcgttatcgctgctcgcacgggcgttgggacgattcatctgacgccacacgccggcgaaatgcggcggattatcccggttgcgcaatagcatgggtaccgaaggacaaccagcattaaggagcattatgagcgacaaggattgcctgttctgcaagatcatcgcaggagaaattccaagcgaaaaagtgtatgaggacgataccacctacgcattcaaggacatcaatccgaaagccaaagtacatgtgctcgtggtgcctcgcaagcattatgcgaacgtggccgagcttgcggcggccgatccccagcagctcgcccacatggctcaggtcgcgcaaaatatcgccgaccaggaattccacggtgccttccgcctgatcttcaacaccggaattgatgctggccagacggtattccacgtgcatgctcacgtgctgaccggcgaaaagcttgacgaataatcttccctttccccatatatcgacgtcagaagaggttttgtggccactactacacgtaccatcgcgattccgcagcagcttgacccggtgaccgtgctcggaccggtcgacgaggtccttcgggaagtggaacgtgcgttccccgacttgaccattatcgtcagaggcaaccgcatcgcgatcatgtcacgttccagcaaatccgaatcccaagccgcacaggccgagcatgtgatcgaaagcatcatccaagccgcatatacggctccgatggacgccgatacggtgcgacgcatgctcgatcaaaacgtgttgaaaaatcctgtgcgtgctactcgcccgggccatggacgtgtagtggaggaactacggctggccgatcggcaacaggagcatacctccaatcgcgagaatcatgcggaccgacgcaaaccgcatgtgcccggagtgatcacctttgcgctcggcaagccggtgcgtgccaaaacggctggtcagatcacatatgtcaatgccatcgaatcacataccatcacatttgccatcggaccggcaggcaccggcaaaacataccttgcagtggcgaaagcggtacgcgcattccaagataggcaggtgcgccgcattatcctgaccagaccagccgtcgaggcgggagaaagccttggttttcttcccggcacattgaacgaaaaagtcgatccatatctgcgtccgctatatgatgcgctttctgacatgctcggggcggaccagctcaagcgctacatggacgacggcaccatcgaagtcgcaccgctcgcatatatgcgtggacgcacgctcaacgatgcattcgtgatcctcgatgaagcgcagaacaccaccgaacaacaaatgaagatgttcctgacccgactaggcttcaatacgaaaatgattatcaccggcgacgtgacgcaggtcgatctgacagtaccgaaatccgggctcgccaccatcgaacgcatccttgacggcattgacgacatcgcattcgcccacctcaaaccggaagacgtagtgcgacacgcgcttgtcggcaaaatcgtcgcagcgtacgaccgacacgcagccattgccggcgaccacagcagacacgccacgggcaaaaccacatccaggcaaacaagcgagcaaatcgaaaggaacgctgaatgagcgtcgaggtaaccaacgaaaccgtctggcaaattgacggcaaggtgttctccgatcttggcatatgggtgatggaccaaatgcgggtcagcacgcaatccgacctgaccatcatgttcgtagaccccgatcccatcgcccaactgcacatgcgttggatgaatcttgaaggccccaccgacgtgatgagcttccccatggacgagctgcgcccaggagacggccgaactgtgatggaaggcgtgcttggagatatcgtgatttgcccgtgggtggctgcgcagcaggcgctcgcggccggacataacaccatggaggaaatgatgctgctgacgattcatggcatcctccacctactcggatacgaccatgccaccccagaacaggagcgtcagatgttcggtctgcagcgacagctgctactcaccttcttcgcgcttcgccagggagcggggacgcaggccatccttccgccggatacgccggatgcgctcgccgaatgggataggcagcatggcacgggacggcagatcgccaaataatgattgacgttgccggtagcatatcgtccggcatgatgggggctgaattatgcaggcaacaatgattgcgatgatcgtggtgctcgccgtggtggcgctgctgttggtctggctgtcgctttcaatggccgcgactgaaggcgctgtgggacgtgtgaccagggcgagcctgaataaccttattctcgaaattcaaacggatgccgagctttcgcaattcatacgcgacaagaaaatcaggcgcattcataaggttcagcggttggtggccgatcgctatgccaccgccggatcgtgcgcgttcttccgcatctgctgcaatgtggttgatggtgtgctcgtgacggtgattgcgggcatgttggacgctccactatgggccgaattacttgccggatttgtttttgccatcgtcattgcggtgatttcgctgttggtgcgtccgcgtagcgccggagcatccaagccagccgacattatgctgcagcatgtggatgctgtttccattgcggttctattaaccccattcgcaaaaatcggggggcaaaaaggcgcgaagcgtcgcggcagtgatctttccgacgacgaggagctcgaaaaaatccagatcgaacaaggacgggcaaccattgaccgtctggtcgaagccaacgatttcgatcctgaagtttccgaaatgctgcgcaatgtgctcacgctttccgaaacgctgactcgtgagatcatggtgccgcgcaccgacatgatttgcatcgagcgagacgaaacgttggagaatatgcttaagctttgctcccgttccggattctcacgtgtgccggtcatcggcgacgatgtggacgatctggtcggcgtggcttatttgaaagatgccgtgcgcgcgacggccttcaaccatgcggcgatgacacgcgaagtcgaatcgatagttcgtgaccccatgctcgtgccggagtccaagccggtcgacgatcttttccaccaaatgcagcgcacacgccagcatgtcgccattgtggtggatgaatatggcggaatcgcgggcatggtcaccatcgaagatgccatcgagcagattgtgggcgaactggaagacgaacatgatcgcacgcaacatgccgatccggaacggatcggtgacaagaaatggagcatgcccgcacgcacgcctatcgccgacttggaagagattttcgaaatcgacattgacgaggatgatgtcgacaccgtttacggcttgctgaccaagctgttgggacgtgtgccgatcgtcggatcctccgcagtcactcgaggcttgcgcatgaccgcggtcgactccgcaggacgccgcaaaaaagtgtcgaccattgtggtggagccggcccacgtcgagggcgtggacgaaactgaaacacgtaacgaagaacatgcggatgatgccgaaaaggcatccgacaacgataaggattccaaagacaagcatgactgacgcagcaacaaccgagacgacttccgaccattccgattccgccacgcccgttccatatcggtccggtttcgttgccgtggtcgggcgtcctaacgtgggcaagtcgacgttgatcaacgcgttgatcggtacgcagatcgccatcgcatcatctcgcccggaaaccactcgtaaagccattcgtggcattttaaccacggataatgcgcagatcgttttggttgatacgcctggcatccatcgaccgcgcacactacttgggcagcgtctgaacgatgttgtggacgagtcgctcgccgacgtggacgccgttgctttcctgctgcctggtaatcaggagattggtcccggcgacaagcgcattttgagccgtctgcgttctgatttcgcagtcaagcgagatgatggcacattcaaatggaaggtgccgctggttgccatcgttaccaagattgacgaattaagccgtgacgggctgatcaacaagctcattgaaatcaacgaattcgccgacttcaccgatattgtgccagtcagcgcgctgaagcatgacaatcttgcggaagtcaagaacgtgcttatcgagaacatgccggaaggcccgcaaatgtacccggccgagcagatcaccgaagagcgtccggaagaaaccattgcggaactggtccgtggcgctttcctggaagaattggatgacgagttgccgcattcactggccgtagtcgtggattccatcgaatatccggaagacaacgatagtggcgaagcttacgatggcaaagcccacgtgattgtgtcgatttatgtggaacgcgattcccagaaaccgatcatcatcggcaagggagcggaacatcttgtgcgtgtcaagaagaagttgcgtacgccggtcaaccgtattgttggacagaaagccaaactcgatttgcatgtcaaggttgccaagggatggcagtcggatcctaaacagctcgagaagctaggcttctgatctgcttaggatccgcttcgcagcgaagctgctcacttcacctaaggacagtccactggactgtccttttgacggttcagccaaacagctcgagaagctaggcttctgatctgcttaggatccgcttcgcaacgattgcgtggaaaataataaatgaggtctgattcccgtaggagtcagacctcattctgctgtttcgaagactacttcttcttggtgtacatctgcgtattcagcaaagtggcataacgcttgatgaccttcggacgaatcaccttcatggaagcggtcatcaaaccattctcctgagtgaattcctccggcagaatgatgaacttacgtacggactccgcacgggaaacaccttcgttggcctgatcgacccacttctgcacttccgcacggacggcggcattgttggcggcctcctccatgggcatgtcgcgattcagccccttgctttccaaccacggacgcaaggattcctcgtcaagcgtaacaagtgcggaaatgaatggacgcttgtcgccaagcaccaaggcctgggaaacgaattcgcaacgcttgataacctcttcgatcggaccaggcgagacattcttgccgcctgcggtgatgatgagatccttcttacgtccgatgatatacaggaagccgtcatcgtcgatacgtcccaaatcgccggtacgataccagccgtcttcagtgaatgaatcctcggaggcttcctcgttcttgtggtacttcgggaacacggcggtacccttgacctgaatctcctcatcttcggcgatacgcagctcgaagccggggaaagccacgccgacggaaccctgatgatagggcacaccaagcggattgaacgcgcaaggagccgtggtctcggtcaagccataaccctcatacacgggcactccggcgccacggaagaacgccataagttccgggtcaagaggagcgccgcccgccacgatccactgggcacgtccgccgagcacctcgcgtagcgaagcgtagaccaccgggtcgaacgccatacggcgagccttggccaaagctccggccttacccttcgcactgacctccttcatgtaattctgggctgccacaacggctgcggcgaacgccacgcccttggcgccatgaccagccttctgcgaggccgcgttatacaccttctcaagaacacgcggaacaacgatcatgacggacggcttggcgacctgaagatcggcgatcagcgtcttgatgccctgcgcgatgtaaatatgcagttcgctggccacgcaaatgtagttgatggcacgtgcgaaagagtgcgcctgtggaaggaacagcagcacgctgttcttcttctcgtgcagcagctgcggcatatacgccggaagattcaacgcggtggtgcaataatgctcatgggtcatctccacacccttcggcgcggcggtggaaccagaagtatacacaatggagcacaggtcggttttcttgatggaatcaatgcgcgcatcgagctcctcgtcgcttacgccggagccgtaggccatgatttcgtcgagaccgccgttctcgaagcagataatgtgttccagtgccgggcattccttatcggcaccatcggctttggcgcgcatatcggtggtctcgaccaccagcaggcgggaatcggaattattgacgatattacggatctgctccgcggaatccgtgtcgtagatcgtggcgagcacaccaccacatgccatgacggccgcgtcgaacacatcccactcgtacgaggtacggcacatgaacgccacgccgtcgcccttcttaagaccgtaatgcatcagacctttggcgatctgacgaatatcggcgagcacctcgttgccggttttggtcacccattcgccgttcgtcttataggtgtagagcggctcgtcacccatacgctcggctcgatcggcgtaaatatcgtagatggtggtgccctcgtccagcggcggcttgccctcggttttggtggtcaacagaccggtttccggatcgaggaacgtggtggatgggaatccttcgccccattcgacggtgtgcggaaggtcgatatggccgtcgggggagatgatgttgttcggatcgttgtaatccggagtgtttccggaatcgtcgctgacggggtgaacgaagtcacctcccaaacgcagtgccttctgcgcaagatttgcagctcgcttgttcaaagaggtgatgacggacacgtgactctcctacacatttaaatccaatatctgtaggaatgatagacccatgaatgcgacacgtcaccttacggtagcgtagggaaagcgcgcatccagcggggcctgcgtaaaggaattgccatgcgatgccattcaataggtgaacttttcttcatacaaaggtgtgacctacgttacactggtgcgctgtatctgttcattttgatttctttaacgaggaagaaagggcacctatggctgaaacagctgaagccaccgtggtcttcggagttctcaatgagacctccgaacacgagtctcgtgttgctctgacaccggatatcgtaacgaggttgcgtaaatcgggtgttaactgcctgatcgaatccggtgcgggcgtcgcatcgcattatgttgatgaggattatagtaaggccggagcgcaggtcgtctccgccgatgaagtgattgcgcgtgccgacgtgcttggtttcgtcgatcgtccgagcagcgcgctgctcggacgcgttaagcagggtacctggattatcggtatgctcggttcgttcaccgacgccgattatgtcactgcgattgaaaaggccggtctggtcggtgttgccatggagaagctgccgcgtcagttgagctccgcgcagtctatggacgagatgacttctcagaattccgtaatgggttataaggcggccatcgtggcggccaacgcgtacggttcgttcctgccgatgatgaccaccgccgctggcacgatccgcccggccaaggtgcttattcttggcgcaggcatcgcgggtctgcaggccatcggcaccgccaagcgtcttggcgcggttgtcaccgcgtacgatgtgcgtccggcttccaagggcgaagttgaatccttgggcgcgaagttcctggatctgggtcttgacttctccaagggtcagggcgagggcggctatgcccgtgcgctgagtgccgaagagcaggcccagcagcaggctgccgtcgatcagaaggctgccggcttcgatatcgtcatcaccaccgccaaggttcccggccgcaagcctccggttctgctgaccaaggctggcgtggccggactgcaccgtggcgctgtgatcgtcgactgcgcggcaagcgacctcggcggcaacgtcgaaggttccaccgtcggcacccaagtcactgaaaacggcgtgaccatcatcggcgctccgtacctgtcaagcggcgtttccactaccgcatccaacctgctgagccgcaatgtggccgatgtgcttgcgcatttcgtgcgtgacggcaagctggccatcgatctgaacgaagagcttgacaacgccatggtcgtggccggccgcggcgaggaagccaagaaggaaggggagtaagcaatggatatcgttgttgcgattactctgttcgtcctcgcgctgctgatcggcgttgaggttatcggcaaggtgccggccaccttgcatactccgttgatgtcgggcgcgaactcgatccacggcatcgtcatcgccggcgttgttatcgtcgccgcgcatgccaccagcccgctcgcctgggtgttcatcttcctggctgcagtgctgggcacgatgaacgtggtcggcggctatgtcgtcaccgaccgcatgctggagatgttcaagtccgacaagggcaagaagaaggaagaggaggccaagtaaatgggtaccatggctgaaatgctgagcacgccgctcggcgtcatcgaatggttcgtctatctgctggccgccgtgatgttcgttatcggcctgcacttgatgaactctccgaagaccgctcgcaagggcaatatggtctccgctgtcggcatgatccttgccgtggtcatggcgttcattgtgctgttcgcaggtgagatctccaacggattccagcatggcgttgccgttgtgctgctgatagccggcatcatcatcggtgccgtcgccggtgtggtttccgccaagaaggtcaagatgaccgacatgccgcagctcgtttccgtattcaacaccgtgggtggcggcgccgccgcgcttgtggctttgaacgacattctgacctccgagggcacgccttccatcgtggtgttgatcaccgctggtttgggcatcatgatcggttccgtcacgttctccggctctctgatcgcagccggcaagctgcagggcatcaagtgggtgaagaagctgaacttgccgggcaggggcttctggaacattctgttcgccgtactgaccgtcgtatccttcgtcatgctgtgcgtgcagccgggccagcgtctgctgtggtccgtgctcaccaccgtgttcgcgctgtgctacggtctcgtgttcgtcatcccgatcggcggcgccgatatgccggtggtcatttccgtgctcaacgcctgcaccggtactgcagtggccatgtccggcttggctatcaataacatcgctctgatcgtggccggcgcactggttggtgccgccggtgtgaccctgtccatcgccatgtccaaggccatgaaccgtccgctgctgtccgtgctcgcaggcggtttcggtggtgccaatgccgccgctggcgctggtgagggtccggaaggcagcatgaaggaaacttccgcggacgatctggccgtacagctcgtatacgccgaaaaggtcatcttcgtgccgggcttcggtctggcccaggctcaggcccagcgcgagcttgctgatcttggtgtgctcctcaagaaccacggcgtcgaagtctcctacgccatccatccggtggcaggccgtatgcctggccacatgaacgtgctgctcgccgaagccaacgtgccgtacgaggagctcgtcgatctggatgacatcaatccgcagttcccgcaggccaaagtggctcttgtggtcggcgccaacgatgtgaccaacccggccgcacgcaagccgggcaccccggtctccggcatgccgatcctcgacgtcgacaaggcccagaacgtggtggtcatgaagcgcggtcgcggtaccggttatgccggtatccagaacgaactgtacttcgaagacaacacgcagatgcttttcggcgacgccaaggcaagcctgcaggccgttatcgcggcagtcaaggagctcatcaactaacagctgaaacgttgcgttgatgcttttcctgaaaggtctcttccggtgagggaagggacctttttgcatatggtgattttcgtaagatcaggtctgttgcatgcgaattgtgagttatccacagtcgttattcgcctgtggatatgggtggagttttccacatatccacagattttcaaggttcggtggcgcaagatgatttgaatatgagacagtaggtgcaccctacaacaaaggagttgcacatggcggaaataatcactggcccgttccatatggatgaacagggatttttggcaacgatcgaagaacttatcgagcggtttgatggatacagttctggcaaatatcttgcggaattgggaaaaatccacgatgaatacggtgagatcggatccctttcgctttttgacgaaaaagtctgtgaactggggaaggaattattctgcagcacatcatgggtggcgaatctggcgtgggccatgatttcgttcgattatgatctggttgagcatgatgcgaattttcttgatggatgccgtaacatcgtgcgtaagtacggtatgagcgtttggctctatgaaatgatcaatgacgcttcgatagcggtggctttgcaaaggcccagcagcagaatgccattccagattggattgacctacaccaaggatgtgtttcggagaagcaagaaaaagggtggaaaatacgctaccagcaaaaagaagagactggcctgcatggctgaatatttgcaggaagtatattggctggccgcgtacagtctgctacgttggggtgaggaagagccgcgtgcggccgatgttgcgttgatggtgcttggatatggcggtatcggcatgtgcatgctgagggacgatccgaaagtggtggattccggatgcgatgaagacttctcctatcgaaatctgtgcgaccatctgcgcgatcttagaattcaagccgatctggactatgcttgcaatgccgaccttgccgaatccatgttgcttgaatatcccgcgtgtatggatgcgcgatatctgtacgatgcggggaaaatcgtggaagcgtatcgtgctttgtggaacaagcagactgaatcagcttcgcaaatcatggaacgcgtttaccagaagggcgcgtatcaggtgacgaacatttgggaggatccgctgtacctgcatgatcttgccctgtcgctgttgggggcagtcggctcgcggccccttactgaagggttccggactcgtgatgacaagatgttccagcagggagtggaaagtctgagacgaacgactgaatccgttaaagggatggggttggcgatgacattgggagggtatatctacttcccggaaccggaaagtagggatgatgcgcttttcgcaccgcgaaaggagaagaaacgattaatggacgcctgtaacgggcttagggatttgtcggcaatggttgcgctctaccgttttccaagggatatcgaatccctgcgtgcaacgcgtgcgcttctcgctcatgacgcgaagggatatatcgatctgatgggtccatacatgggaagcgcggatgagacgggaggaaacgaggggaggccggtttcaatcggcgactgatcggcctctcagatcgcgaacgtcaaagcgtatgcatcatggttgtgccgagattgaatggcggaacgttcagatgaactttgtctcttcgatctcggtgcatgctatgccgtattgctccaacaattcgcgaaatgcttttacgtatctatctgtggcgaacttctgtgtgaatgacagacagaagttctcgtttacgtaattcacttccaccagcgtggacgtccaatccgcataggcgtaacaattttggacatgccgtgccaaagaaccccgatcgaacattcctgtataactgatgtcagccgttgaacatcgcatgctgataacttgtctgcacatctgtttctgggcttccagattcggcaggctctcaggatagtgattcagccaagtggttcctgccagcttgggaatcagtgtttcaatatcgcactcgtctacctgttcatggggcattttcagcttggtccggcagatgcggctcttggcacaatctttgcacagaccatcagtgtgatcgtcgcgctggtggtgattcgttgcaagcagaaaggcattcgtttaaggaaggctgatttcaagccgaatcgcaatatgttgggcggcattctcagcatacggacgttcgtatatcggcttcattaccctgccttacttggaaatcgtatcgtcaaggtgcgcaaacagtgggcgagccaaccatgccaagggtagtgatgccagtgctgaaatcagcagtataagccaaaccgtgcaatgtgcgtgcagccatccgtaaagcatttgcccgagtggctgggcgcatatcgtcaatgatgaaataatggccatgaccttgcctgtaagcgcggttggtgtcctcatctgaatagatggtacgagaatgaggttcaagaaatcaacggcgattatgactgccgcagtgcagagcaccagcatgatgagcttggtttgcgttgaacatggaagcaggaaggcgatggccggtgggagcagcataagactttccacgaacaacaacgaaggggcgtttcgtgatttcaaacggttggcgaaacacccagcgatgaatgttcccgctatgccggcaatgccgataatgccatcgcatagaccatatgtcgccgcatcgtagcctaacgtagttcgaataatgtaaggaaagcttactgaactgaatccagtcagtatcagattgatccatgtgcaaacaccggctaatcgtgctacggtcggctccttgcgaagcaggaaagcggtcgccgaatgcatatcgccaatgatgacgtcgagcaggcagatgccggcatcatcttgattcgataggggctttgcgagtctgatgaagcattcaaccatggctgccgacagaagacatgctgcggtgatgagcatcatcggtcgaatgccgaccagcccgtacatcacgccacctaggaaactcgggagtaattggctgagctgctgcacttggttgatgatggccgcgcctcggcgaagatcagtggaggactctcttccgatgatttgtggcagtgcggattgcacgacgggagtttccatggcatcgagtactgccaacactacctgcatgatggcgatggcgagaatgttgaatccggatagtgcgaaaaacacagtcgcgagcagtgtgacgattcctgagatgatatcgagcgccaccatcatggcacgtttgcttactcggtcggccataacacctccgaatgggctaataagtatggtcggaatgacggatatggccagcacggtggcgaaggtcgtggatgatgcggtttcgtccagtacccacatggacatggcaaatcggagcatggtattgccgaacaaggaaatgccttgaccgagtacaagcaggatgaagtttgcggagcgcaagctggattggagtgtctttgctgacgagtttttcatgactattcctttcgataccgactgacggtatgtaaaaaaaggtacaaataaagatagattgacattgccgagcttttattgcggattactggcgagtaggaagaagccttccgcaagccgatcttccatatcactgtcgtgatcgataagtggaactccgagcgagtccataatcaatccaagacagtggatgcgatgcttgaattcacttagggtagtgatggggtagaagtttggggctagccagtaattgaacagcagtgaaaaaagttccgcggcttcttgagggtattcggttgtgattgaaccgtcccttaacccctcctggatgaagtcgtacgcgattttggtgctgtcggttcgccagatgcgaagattttcggcgaggattttcgggtcgttcagcaggggaaacgcatcgcgcatgagggtcatatgttcggtgtcggtaatctgcatcatgagcgaattgcgtagtttctgcaatccgtttcgtgagccatcctcttgatttgcctggggaagaagtcgttcgttgtcggaatctaccagcgcatgcagcatcgcttctttgtttttgaaatgatggtagatagcgcctttgctgaggtcttcgagctcgtcgagaatatcttgaatcgtggtgtgctcataccccttttgcgcgaacagctttttcgcggcgtcaaggattcgctgtcgtgtcacctcagggtgcgcattgcgcgccatatgcctctccttcaatgatggagtcgaatacaccgacattatacataccgttggtcggtatggtatgtcggatatctcccagctcgatcgaaaagtgtgccgaaagaatctctgtagatttctgcgaagaaacctgaatctgcgttgccggggtgcgggatgtctgtcttttctgcggttggtgcatgattgggtgtccaaggtcaacttgagtgagtgacggctgggttcccgaagggaataagaccctggttcctatatgcctttttatggcatggggctttcggtgaagaacgattgcatccgatgtgaaaaatcccacaaatccggcccacgtcctgctcgagaacttcaaaactgttgccaatactggaaacacgccgtatatagtgtttggaaatgtgacgagacactgtatgttgtggtcttgatttttattttcgttcggataatgtgtgccacgtaccaacgacgtacggtcgtgaaaggacgtggaacatgaacattacgttatacaccaaagcaaactgcccgcaatgcacggcgacgaaacgccaattggacaaacggggccttccctatacgactgtcgacattacggccaacgcacgtatctccgacagattgcggaacgaaggatggcggcagatgccagtcatcatcgcagacgacgaatcctggtccgggtatcgtcccgacaaaatccacgagctggaggctcgctgccggtgagtgcgttggtgtacttctcgtcggcatcgggcaatacgacacgcttcgtcgaaggatgccgattggatgaattcggcattcatacaatgcgcatcccgctgcggccggacgagccggagctgcatgtggatgagccctacgtcttgctgacacccacatacggcggaggaacaatcggcaaagcagtgcccgtgcaagtcaaacgattcctcaatgatgaacgcaaccgcagtggcatcatcggcgtcatcgcatcgggtaacaccaacttcggcgaagcctacggcatcgcaggcgacatcatcgcggctaaatgccgcgtgccgctactctaccggttcgaactgatgggcactccggaagacaccgcgaccgtgcgcgaaggactgcgcagatttttcgacgaatacacacaacaggaacaacgataaccatgccagaagattcaacgacaccacacgcagcaaccgacgtcatagcctcctacgatcgcgcccatgactggcactcgctcaacgcgatgctgaatctctacgacaagcaggggcgcatccaatttgataaagacatccaagccgtacgcgagtacgtcgaaaagcacgtgctgccgaacaccgtccgcttcaactccacacaagacagactcagccgactcatcgcagacggctattacgacgaattcgtatttgcccaatatgatgccgaattccttgacaggttctaccgcaacgtggatgactgcggattcgaattcgatacattcctcggagctttcaagttccaccgctcatacgcattgaaaacctttgacggcaaacaatacctggagaacttcccgcaacgcgcggccgccgttgcgctcgcgcttgccgccggcgaccatgcggccgccgaatcgtatttcgaagaacttatatcagggcgtttccaaccggcgacgcccactttcctcaacctcggcaaagcccagcgcggagaggcggtcagctgttttctcgtacgtatcgaagacaacatggagtccatatcgcgtggcatcaacgccgcattgcagttgagcaaacgaggtggaggtgtcgcgctgttgcttagcaatctgcgcgcggccggcgcgcccatcaagcgcatcaaacaccagtccagcggcgttgtgcctgtgatgaaactgcttgaggactctttcagctacgccaaccagttgggcgctagacagggggccggtgcggtgtacctcaacgctcatcatccggacatcatgcatttcctcgataccaaacgcgagaacgcggatgagaagatccgtatcaaatctttggctcttggagtagtgatacccgacatcacattcgagctggcgaagagacacgaacctatggccctgttcagcccatatgacgtcgaacgcgtcatgggcagacccttcgccgatgtctccatcagcgaaaactaccggaatatggtggacgatgaacgcatcgggaaaacctacatcgacgcacgagagttcttcatgactttggccgaattgcaattcgaatccggatacccgtacatggtgttcgaagatactgtgaaccgagccaacccgatcgacggacgaatcgccatgagcaacctgtgctcggagatcctccaagtgcaggagccaagcacctatcatgaggatctgtcctacaatcacgtgggacgtgacgtgtcctgcaatcttggatcgctcaacatcgccaaagcgatggacggtgatttgggacgaaccgtggaacgtgcgattcgcgcattgacctcggtgtcggaacatacggacatcgcgtgtgtgccatccatccgacgcgccaacgacgaaggtcatgccatcggcttgggacagatgaacctccatggattccttgccagagaatcgatcatgtacggttcgccggaagccctcgacttcaccgacatgtacttcatgaccgttgcgtaccatgcctaccgtgcctcgcatgagctcgcagtcgaacgcggaacacggtttgcaggcttcgaacggtccgcctatgcgaagcctgcaggcgcaggcaactatttcgacaaatatacgaacggcgagcgctcgctggcgccgaagaccgggaaaatcgcgtcgctgttcgcacggcggggcatccatatccccaacgaggatgattggcgtcgtctgcgtgacgacatcatacgtgacggtatcttcaaccaatatctacaggccgtgccgcccaccgggtcaatttcgtacatcaatcattccacgagctccatccatcctatcgcctcgaagattgagattcgcaaggaaggcaagattggacggatctactatccagctccgtatatgaccaacgacaatctccagtatttcgcggatgcgtacgaaatcggatggaaggccattgttgatacgtatgccgaggcaacgcggcatgtcgatcaaggcctgtcgttgaccttgttcttccccgatacggcgactacccgagatttgaacaaggcgcagatttatgcatggcgcaaaggcatcaaaacgctgtattacatccgcattcgtcagcaggcgttgtctggcaccgaagtacaaggctgcgtcagttgcatgttgtgaaacctgtgacttgaaaggaaaagaaaagacatgtctcgtttggtttaccgcgcgatgcttcgtctgacggctccggacgaatacaggcggttatacggccgcgacgataagacgacgattagaaaggacgaccatcatggcgccgatatccgtacctcgacagaggattaagctcattgaccgtgtgagtgccatcaactggaacaaacttgaggatgacaaggaccttgaggtatgggacaggttgaccggcaatttttggctgccggagaaagtgcccgtctccaatgatttgcccgtttggcgcacaatgagcgaggccgagcatacgttgaccatgcgcgtgttcaccggtctcaccttgcttgacaccatccagggaaccgttggcgcggtcagcctcatacccgatgcgcttaccccgcatgaggaagccgtctatacgaacatcgcgttcatggagtcagtgcacgccaagagctattcctcgattttctccaccttgtgttccacccgacagatcgacgaggcgttctcttggagtgaggagaacgagtatctgcaaaggaaagcgcgcatcgtgctcgactattacgagggggatagtccacttaagcgcaaagtggcctccacgctgctggaatcgttcctgttctactcaggcttctatctaccgatgtatttctccgcgcatgccaaactcaccaacaccgccgacgtgatccgtcttattatccgcgacgaagccgtgcatggttattacatcggatacaaatatcaaagagggcttgagcgggtcagcgaggacaaacgcggcgaactgcgcgactacacctacgacctgctcaacgagttgtatgacaacgaggtggagtacacgcgcagcctctacgagcctgtcggattgacgcaagatgtcgaaaagttcctgcgatacaacggcaacaaggcgttgatgaatctcggatatccagcgcttttcccacaagagatctgcgacgtgaacccgtcgatccttgccgcgttaagtccgaacgccgatgagaaccatgacttcttctccggttcgggaagctcgtacgtaatgggcaaatcagtcgagaccgacgacgatgactgggatttctgactgtatcccagacaaccccgaggaaagcagctatgggaaaccgtcacgggcgagttcgcgtcggatcatccacgcagatatctgcccgtgacgctgtcaggacaggcacggaccgtttccggtgttccctcgcatacgatgcgaccgccggccatgcctccgcccggacccatgtcgatgagataatccgcgttcgcgattacatcaagatcatgttcgattactacaactgtcgccccagaagccaccaacgagtcgaacacgcgtagtaataccagcacatccaacgggtgtagcccgatcgtcggctcgtcgaacacgaataccgaaccggactgtccgcgtcccatttcgctggccagcttcagccgttgcgcttcgccgcctgataacgcaggagtcggctcgccaagtgtcagataccccaggccaagctcatgcagtgtggccagtttcgatcgaacggggcgtaggaaatccaatagaggcatcatctcgtcgacgcttagcaacatcaattccggcagtgaacgggcgacgctgtccgcgcaaaccaatcgaatgtcatcggcggtctgtgcataccgtgtcccatggcaatcgggacacgtgacgtcaacatcgggcaggaactgcacgtccaacgaaatggtaccggttccatcgcaagtggagcagcgcaacttgcccgtgttgtatgagaatgcgccaggtttgagattcttcttatgggcatcggaagtcttcgcaaacgcacgacgcagatcatcgtgaacaccgcaatatgtcgccacggtcgaacggatgtttgctccaatgggcgtggcatcgatcagttccactttcgaaatgccatccgcgtcaatcagacgaatcgagctcggggaaacggtaccatcagcggccgagcgcaacgcagggaccagtgtctccaataccatcgtcgtcttaccggaacccgacacgccagacaccacagtgagacgtcctcgcggaatgtccaccaataacggatgcaccgtatgcacggtattcgtctccaaatgaatccgacccttggcgaacatcgcatctaagtcaatctgcggccgtgcccgctcatgtattttgccaccatcacgcagaaaaggcgctatctgagaaccaggtgccgtcataacatccgccaccgcaccctgagcgatcacatgaccgccttcggcaccggccgttggacccatctccaccaaatgatccatcgcggcaagcacacgggtatcatgatcgaccacaaccaccgaattgccgtcagccaccaaatcgcgcatcacgcccaacagtccatccacattcgccggatgcaatccgatagacggttcatccagcacatacagcacgcctgtagtgcggttacgcaccgaacgggccaactgcacacgttggcgctcgccggtggacagtgtcgcacctgcgcggtcaagcgacaaatagcataatccgagttccacgagccgctcggccgtatcctcgaacgattcgcagatggctgtggccatcgcacgcatctcctgcggcaatgacttgggtactgaacgcacccaacgtatcgtttcgtcaagtgtcatcgccgtggcttgtgccagatcaagaccgagaatctgcggttgacgagcctgctgtgaaagcctcgtaccggaacaatccggacatggttgctcgctgaggaatctcgacacgcgtttgatacccttctcatccttggctttggcgagcgcgttctccacggtatacacggcgttgaagtacgtgaagtcaagttcggcgaaatcattgcctttcttcggtttgtatagaatatgcttcttgacggccgggccgttgaacacgatgtcccgctcggcgtcggtcagttggttgaatggaatgttcgtgcgcactcccatcgcgccgcacacctgcttcatcagatcccacatcaacgatccccatggtaatactgcgccggcgtcgatgcttttggtctcgtctggtaccagggaagcgcggtcgacggttcgcacgatgcctgttccggagcaggtcgggcatgcgccggcggaattgaacgacagctgttcggcggatggtgggtgcatgagttgattgcaggatgtgcatcgtataggcaactcggccgccacgttcattgtgggacggttgcgttcgccacaatgctcgcagacatgtgaggcgcaacgggagaacaacagacgcagactgttgagcagctccgtcatcgtgccgaacgtggatcgcacgccgggcactgaaggtctttgatggagggcgagagccgcgggcacatgacgtatgtcgactacctgcgctcgactcgcttgggtgagacgtcgcctggtatacgtcgacaaagcctccagataacgtcgggatccttcagcgtatagcacacctaaagcgagagagctctttccggacccggagataccggcgatgccgactaatttgttcaacggaatgtcgacgtcgacgttcttgagattatgcacgcaggcaccgcgcacttcgatgcgggacggcgggaaagctccagatgattgttccatacccactacagtacctgtgtggcggaaaacacgcgggcaggggaaccttgttcgtcatggtattgctgcaattgtggtatctgatccatatattcgaccgcaacggaggggatgccattgtttttcacggctaccgtcagcgtacgtgaatcggaaggcgatgcggtggaatacggggaaatggattgggaaaggaaggaatcatatacatcgtatatatcaatgggaagaagttcgccggggagcggaaccaaagtctgttccccggcgcagagcggctaacaggcgaatgcccagaacatccgcataaggcgttgatgggctcatccgccgtgtcagcgtgttgaacgatgtatcatgccgctcaacgtgatgataaggcgttggcgtccttgcctttcgtggcgagcgtcacggcgatgatggatgcgagagcgacggcgtacagtacggtgatgatcggaatcagcgcgctgtatcggtgggccgattccgtcgtatgggagacgacgacggacgccagctggttgccggacaatccggcgaacgcccacgcgctcaaagccagtccgtgcacggtggacactgacttcatgccaaagtgctgctcaagcagcgccggcggcgttgaacacggcatcgacggtcaggatgacgctgatgcttcccgcgatggccttggccagaccgaatcccgcgacggcgatgccggtggcgagacctttggcgaaccacagcattaggttcttcaccggcgtcagatagccgacgcccaatccaatgcccatgattacgccatagaagatgagcacgccgggggcatcccgccgcgatactggctccggtaccggcgaacctgcaggcaaagcagaccgtcgagatcaaagccgatttcttgatgtccttttcgacgaagggtccaaggaaggcggccgacatgccaaggatgttgattggccatgtaatattcgttcctctctgttgtttgttcgccctgcgacgaacaaacaacaagataatggtgaagtattccgtggccttgagcgtgccgggaggcggcagaagtgggtaagccgttgatttcattggattttccaacaaatgaacattgtgtatgttcaccttggggataagcatgaggaaaatctcatgtgaaccttgacacagttttcatggctcacaattcgaatgcgcgtttgatgaaggcattgacggtgttccaatacagttcgggatccacgacggatgcttccatatggcgtgcgtcgggaaccatgagcttttctcgatcgatgctcgagcacgcttcgtaattgatcttgagaaaacgtgagctcacgatgtcgtcctgttcgccatgaatgaatagcatcggaatgacagtatgtctgagcgactgcagacaggtggcttctgaaaaatcgtatcctgcataatgtttgcagaacaatcccgcggcatccacgcataccgcggcaagcggtttcggcagacgcgacgaatgccgaaggctgtcgatgaacaccatgcgcgcagacgtgtagccgctatcgacaatcgcggacaccacattgcgcggcagacgcgggtctcccgtcgtcatcatcaccgttgccgcgcccatcgaaccgccatacagcaggatacgggcgtcggcgtcactcgacgcgataaggtcgatccaattcagtagatcattgcgttcaagccagcccatgccgacgtaccgtccctcgctcaagtcttgggcacgctgtgacggaaccaatacggtgaagcccatgcgggcgtaacgatgtgcccatttcgcggtttcctccggtacaccggtataaccatgcatgcagattgcgtacaggtgtggttttggcgcagtgcaatccggatcgaacagccatccatgcagtcgaagtccatcatcgctggtaatcgtcacaggctgtttagcttgcgcgaaccattctcctgcttcctgtgcctcaccctgctgaagtttttcgatacgctccggcgcaatcagcgattgatggaaaacggaacgtttccattgcgtatcgatgcagaaatggaacaggtatttcgcagtcgtagccaacgatgcgatacaggcagccgtcacggctcccgtggcgatgcaaatgtcgcgaacgattgtgtcattgtcatgcttcattgctatctcgtttccttgcgattgacggattgttcacaattactatcgattgtacgtgcgtacggcgttttcgtgggctttgacagattttttcatttttgatgtgagacgtttttcgataatgtccgccctcgccgtatactggttaactgttgtcttggcgagggaagcgtatggcttccgtaatcgactcggcgtgtgattgtaggctccttgtgggttgattcacggctcgttgatgcgtcgaaacagaatgaacgaataaaacataaggagaaatagcccatggctaccactattaccctcgaaggcgctgcccgtaccgagttcggcaagggcgctgcccgccgcatgcgcgtcgccaaccttattccggccaccgtgtacgcaggcggcgaagagccggtcttcgtgcagctgccgatgaaggaaaccactctgtccctgcgtcacaccaacgctctgttcaccatcaagttcggcgacgagaccaagatggccgtcgtcaaggacgttcagcgcaacccggtgaagcgcatcgtcgagcacgttgacttctacgaggtcaaggccggcgagaagatcgacgtcgaggtgccggtgttcgtcgagggcaccccgaagggcgctgccgtcgcattcgtcgacattcaggagcttaaggttcgcgccgatgtcgccaacctgccggagaagatcgtggtcaacgttgacggcctgaccgacggttccaaggtcttcgccaaggacgtcgtgctgccggaaggcgttgtgctcgacgttgaggatccggaagagtccgtcgtcaccgtcgaggtgccggaagacgctgccgatgaggctgctccggtcgaagccgctccggctgaaaacgctgagtgagttcagttagcttaaggaagttaactttcatcttacggttttgaaaaaccgtaagagatgatgaaaagcccatgtgctcagacgcgcgtgggctttttcgtacccggcaacacccgttctatgagctggaaggcatacgaaactgacggcgcatcctgcatttcttacgcaatattggtacaacgggtggatacgggctatacgcgcctatacgttcagtgaacccgtatggcactgtcgggtgcgaggggaacgtttgcgtactgccggagacggactgcgtgacgatccgttttcccggcagccatcctgatgccgcacattaatggactatatcgagaatcatcatttgacggtggtaggcttcccacgtgagatcacactgatcgacaatggtctgacgcaggattccagcaaatacgtgacgtgcatcagcattccaatcgaataacgactagtatgactgacggtgcacggaaacaatgcacgagagacaaagtgagacggtgcggaagagagaaacatttgaataagcgtattattcggcttgatgtggtgatggtggtcttccttggcggatgcgtcggcacgggactgcggtatgcgagctcgttcattgcggacgtgggcagctttcacgtcggcacattcgcagccaatatggtggcctgcttcgtatatgcggcgctttccgcatggctgggatcttccagtctgttgaaaggccgtgcaaaagaatacgtgaatcgtggattcggcatgggcatgtgcggaggcctttccaccatgtccacgctcgcattggaagaattcatgatgattgacgatcacgcgattcccagagtcctcacctattgctgcgcaacgttcattgtcggtttttcgctcgcctacgccggtgccttatgcggttcgtggtcggtggaacgaaacaaagacgaacatgctgacaaggaggcgattcgatgagcgcaatgcttgcgatcggcgtatgcgcatgcggtggcgtcggcgcggccgcacgctatatctgcgattcgtatatcaaggcattgtggcgcaaaacgttcccgctttcgacgtttgccattaatgttgtggccggtctgcttgccggcttggtggcgggattgttcgcggcgaacaccataagccccgactgccgcctactgctcgcaacaggatttctcggcggtttctcaacgttctcaaccatgatgaacgagacggttacgctcctgcgcaatgggaaaatcgcttgtttcatcggttatgctctggcttcgatcgtcatgcccgtcatggccgttgcatgcggttactggctggcctgagccaacgtaaacgtgattccaaaatcacgtccgaatgcagagactgacttaagtccgcgcgtaacatgcaactacgctcggggctatcgaaatcacgtataccgatgaaaagaagttcaccaaagaacagacgcagcaactgttccgatccgtcggatgggtgtcaggcaaatatccggaacgtctgtacaaggctctgatgggatcgtccaccgtgttcagcgcatgggacggcgaccgcttggtaggcttggtgcgcgtgctcgatgacactgagatggtggcttatatgcattacgtgctggtcgatccggaatatcagggtcatggcatcgcaggccacctggtgggcatggtcaaagagagatatcgcgactacctttatattgaagtcatgccggaagaaagcaagaacgccaccttctaccagaagcacggcttctcaatcatggaagacggcgcggccatgcagatctgcaatccgggagaacgccgctgaaacaagcatcgtgacgccaacaatcttattgcccccgtctaatgacgggggtattgctttttcgagtatccgccaatacatcggagggttggcttgcatgcttcacccgaaaggatcgcagcatgaccggaagcgacgaacggaacacgcagaacgcgacgagtgttgggaaggctgcgtttccagcgccttccgccatgaagtctcctcaccccaataggcgacagcggcatgttgtactacgacgtcgaaactactcgccccatcattctcgcccacatcccgctgtcagagacctgaacgtcataatggtgttttggggaatgaggcacagtcattttttgaacaattcagaatacgttccgagtctatagagcatcaatcaggcgtgagggcggcaactttttcgcaggatgtttcttcctatctcatatcgcgaacgcttgtaatcgaaagagattatgatgtgggaaagttactaaccagaaccggtgccacaagcactgggataccaacaaccgcgggccgcttttgggcggctgcaacaagaagaagtaaagaatgactgaacagaatcatcacgatccggcagagcttgacaagctcaccgagaagttcaccgtgctcccgaacgaaaacccggcatccgacgccaaacgtgccgaactcatcgacaagccggcattcggtcaggtcttctccgacaacatggcccacatgacttggaccaagggcgaaggctggggagaccgccgcatcgagccgtatgcgccgctgaagatggatccgggcgcatccgttctgcactacgctcaggaatgcttcgaaggtctgaaggcctaccgtcatgccgatggttccacctggctgttccgtccggatgcgaacgccgagcgtttccagaactctgccaagcgtctgtacctgccggaactgccgatcgacgatttcatcggttccgtggccgccctcgtcaagcgtgacgtgaactgggttccgacccgccgcgagtacactctgtacatgcgtccgttcatgttcgcttccgagccgttcctcggcgtgcgtgctccgcaggaagtggactactgcgtgatcgcatccccgtccggcccgtacttcccaggcggcgtgaagccggtcagcatctgggttgaagacaagtggttccgcaccggccctggcggcaccggcttcgccaagtgcggtggcaactacgccgcatccctgctgggcgaatacaccggcatcgaccacggctgcgagcaggtctgcttcgtcgacgccgctaccaagacctacctcgaggagcttggcggcatgaacatgatggtcgtgcacaaggacggccacgtggagaccccgtctctgaccggcaacattctgccgggcgtgacccgtcgctccctgattcagctcatccaggacaacggccacgacgtggtcgaaaccatgatcgctctggaccagttgctcgaagacatcaagtccggcgaagtcaccgaggtgttcgcttgcggtaccgcagccatcatcaccccgatcggtcgtttcaagtccgagaagttcgacgtgaccgttgccgacggcaactccggcgaattcaccgtgaacctgcgcaaccagctgctgggcatccagcttggcgagatcgaggatccgcacaactggatgtggaaggtctgctgatttttcgcgactgacttatagttcaaagtccgccgaggggcgggaaacatggtgttcgacacactcaaggccgttcggccaagcctacggtcgaacaccatgtttcccgcccctcggcttattgtgtacgatgggaagtcgcgaaatccgagagtgagggaaggaaaaaggatgggaaagcatgtcggtggcgttggagagtaatgccttcttttgggggattgaatatttggcgacgttctgctgcggcatgtgcggcggacttgccgccgtgcgcaaaggctacgatatcttcgcgattctcgtcaccacatggctcaccgcattgggcggaggaatcatccgtgacgtgctgctgggcatcgcgccaccggtaggcgtgtcggataaaggactggtgatcgttgctctgctggcttcggtggccgtcgcggtgtgccatcccgaaatcaacaagctcaaatggtccatgctgtcgttggacgctctggcattgggattgtatgcggtcaacggtaccagcaaagccatgatgcaccacacgtcaggcatgaccgcggtttttctcggcatgttcaccgcgcttggaggtggcctgattcgagacatgctcatcaacgaagtgccgatggtgattcgtgacaaacattggtatgcggttccatctgccgtggggtgcgtactgacggtgcttgtctgcaaaggcgtggacgctggaatcgtcagttttccagccgaagtggtgcttgatctgctgatcgtcgcattgatggtcagcatgcgattggtatcggtgattttcgacattcagcttccgggagcgttggtgcgtcataatacatatctgccaagtgaagcgaaatatttgaaacgaccggtcattcattctgataaggattccgacaaacgcaagtgtgacaagcgtaggtagcgacagtgagatggtaattaaacggaagacatttgcgtaacaaaaaatcccgcaggaaaaacctgcgggattttcgttagctgtgagcttctaaaactcagagagcgttgatggccacggcaagaccggacttgcggttagcagcctggttcttgtgaatcacgccagcgccagcagccttgtcgagcttctgagctgcgaccttgtaggcggcttctgctgcggacttatcgccggcggcgatagcttcacgggtggcgcgaacggcagtcttcaggctggacttcacggccacgttgcgcttgtgggccttctcgttggtgagaacgcgcttcttctgcgacttaatgtttgccactatttctccaaacgacgttttctataaggacatacaaacgatgatgataacatggcgcgcggataaattgccaacgggcttaggagtgtcgcgactcaccatgccgatactagcagttagaatcgtttgcgtcgaatatttcaagaggaggatggcgtgggccagcagcataaccagcccggtttcaccgatcagtcgttgattcgcaatttctgcatcatcgcgcatatcgatcacggcaagtccacggtggcagaccgtattctgcagctcagcggcatcgtgcccgaacgtgagatgcgtgatcgtttcctggatcgtatggatattgagcaggagcgtggcatcaccatcaaatcgcaggctgtgcgcgtgccgtggacgttcgacggcaccgaatataccctcggcatgatcgacactccaggccacgtcgatttcacttatgaggtttcccgcgctctcgccgcatgcgaaggcgcagtgctgcttgtcgacgcgacgcagggcatcgaagcgcagaccctgtcgaacctgtatatggccatcgaccatgatctggccattattcctgtactgaacaaaatcgatcttcccagcgcggaaccagacaagcatgccgaggaaatcgcaggcctgattggttgcgatccttccgaagtgctgcgcgtgtccggtaaaaccggtgaaggcgtgaccgaactgctcgaccgcattgttgccgacgttcctgcaccaaccggcgatccggaagctcccgcgcgtgcgctgatcttcgactccgtctacgactcctaccgcggcatcgtcacctacattcgtatggtcgatggcgagttgcgttcccgtgagaaactgcacatgatgggtattggcatgacccatgatccgattgaaatcggcgtgatcagcccagacatgatgcctacgaaggcgcttggtgcgggtgaggtcggttatgttatcaccggcgcgaaagacgtcagccagtccaaggtgggcgacaccatcacttccgcgctcaagcctgcggccgatccgctcgaaggctatcgtgacccgcagcccatggtctacgctggcctgttcccaatcgacaacgcgcagtatccggaacttcgtgaggcgctcgacaagctcaagctcaacgacgcggctttgatctacgagccggaaacgtccgtggcgttgggcttcggtttccgctgcggcttccttggcctgctgcatatggaaatcgtgaccgaacgactgagccgcgaattcgatctcgacttgatctccaccgcaccgaacgtgccatacgaggtcactgcggaagacaattccgtgcatcgtgtgaccaatccgagcgaattccccgacggcaagatcaagcagatcgtcgaaccggtggttgccgccgacatcatcactccgaaggaattcatcggcgcggttatggacttgtgccaggaccatcgtggacagatgggcactatggaatatatttccgccgaccgtgtggaaatgcattatcgcattccgttggccgaaatcgtgttcgacttcttcgaccagttgaagagccgcaccaagggctatgcgtcgctcgactaccatgaggacggcgaacagtccgccgatctggtgaaggtcgatattctcatccagggtgagaaggtcgatgcgttcagcgccatcgtgcacaaagacaaggcgtattcctacggcgtgatgatgacgaagaagttgcgtgagctcattccgcgccagcagttcgaaattccgattcaggccgccatcggctcccgcattatcgcacgtgagaacattcgcgcactgcgcaaggacgtgctcgccaagtgttatggcggcgatatttcccgtaagcgcaagctgctcgaaaagcagaaggccggcaagaagcgtatgaagatgctcggccatgtcgaggtgccgcaggaggcgttcatcgccgcattgtcgaccggagacgcaggcaacgaccgcgacaccaaagacaagattcgcgccgcccagaaaaccgaaggctgatgttcgaagcctacattcatgtgccgttctgtatacggcgttgtgggtactgtgatttcaacacgtataccgctgtcgacatgggagcgggcgcttcgcgtggcaattacgccaatatggtgattcgcgagatgtcaatcgtccatgattggcagatcgcgcatggcgttaacgaaccggaagcggccaccgtctttttcggcggtggcactcccacgattctgaaagcctcggatctggtcgccatgttgaatgccgtgcgtgacacgtggggcattgccgacaatgcggaaatcaccaccgaagcgaatccggacacggtgaacgccgattacgtgaaggaactcgcggacggcggattcaaccgcatctctttcggcatgcagtcggctgtgccaagcgtgctgaaaacattggatcgtacgcataccccggccaatgtggcggcgggaatcgcagcggcaaatgctgccggcatgcgttccagcgtggatttgatttacggtgctccgggggagagtctcgacgattggcgggtttccgtacgtacggcgatcgacttgggtgttgaccatatttcggcatatgcgttgaccgtcgcaccgaacacgaaaatgggacgtcagattgctgttggaaccttgcctacgcctgatgatgacgatgaggcgaccaagtatgagattgccgacgatctgctgagcgcagccggtcttgaatggtatgagatcagcaattgggcacgtcctggttatgaatcgcaacataatcttggctattggcgtaatgttgattgggcggggctcggtcccggcgcacacagccattacggcaatgtgatggatgttgaacagtccacgtcggctgaaacatctgaaacggtcaaatcgtcgggcttgcgcagctgggatattgcgcatcctcgcatgtgggggcaggctatcaacgatgataatgtgccatggtcgggaagcgaacgaatctccaacgaggagaacctcgaagaaatcatcatgcttggtctgcgcatacgtgagggtctggatttgagtcgccttggaaacatagttgatatggctcgcatccagcccatggaagacgaaggccttatcgttatccgtgacggacgtgtgattccaacccgaaccggacgcttgctcaacgacaccgtcatcgagcgtttcttcgacgcctgctcgttgtaatgccgataatcctctgacgaattggttttatatgatccatcttggtatgggtggatacagtgtgcagattgaaacgggcctcggatgcaggtcgttgcgttccaggcccgatggcatagagcctagaacgaggctgtcaccggatgttcgtaatcagcgcatcgtgagtccgccatcgacatgcaacgtctgaccggtgacgaaacgagcgtcctcgccaaccagcatcgccacaccgcccgcaatatcatcagccgtggcaagcctgcccaaaggcgtctgcgcgatgatgcgctcgcggacgtcttcggtggtggcgcggctcgaatccgtgcccacggtcaaaccggccgcgatggcgttcaccgtgacgccccacgctccggcctcctgcgccagcgagcgcgtgaatccgatgagtgctcctttggctgcgatgtagtcgtggtaggggacgatcgggctgtctacgaggttgctggagatgttgacgatgcgtccccatgattggcgtcgcatgtagggcagcgcggtcgtgcaggtgttgtaggtgcctttgagacatccttcgagttgggtcgcgtagtcgttccagctggtgttgctgaaggtgttgcggttgcgtgggtcgaacgagtagtggctgagcgcgttgttgatgaggatgtcgatgccgccgaaggtgttggctgtggtttgtgcgagttcgttgacttggatttcgtcggtcacgtcggctttgcatgtgatgacgcgtccttgtgcgtccgcttcgttttcgatgtgttgcttggtgtgttgggcgcgttcgtcgttgcttaggtagtcgatggtcacgttggcgccgagttgtgcgagtctgagtgcgattgcggcgccgatgcctcggcttgcgccggtgatgatggcggttttgccggtgagtgtccggtgttcggattgctggttcacgtaaggtcctttgggattattcgtagtcgatgtcgaaggtgtcggcgtaacggtcggtgttgcgttcgatgtcgacggctctgacgaggtcgaggatgttgaatccgccgtcgtggtgccatccggatttcgcgcggttcatttctccgacggggcagatgcggtcgatgccgtattcgcccacttgttgcgcgagtgcgaacagtctggatgagcttgtggcgatcgcacaggtttgcagccactcgcggtagggtttcagtgtgggcagcgcgtgtttgagttggtccacggcgacgatgttaatggtgcggttgagcggtgtccccaacgaggggagactgctggtattggggtagtagagcacggtccagtcggtgccttgcggcgattcgatgacgaacggtgcctgtgggtcggcctgtgcggcgctgtctggagtcatggacgtcatgaacagcgcttgcatctcggtttgagagcgtgccctgcggatggcgagggattccgtgtcggaaggggttgatcgtggatatttgcgttgttgcgagtcgagctcgctggcgagcagttccgccgtctgagcgggggagatggctccgccgcgttccacgaagatggtttgcggcgccaggcagctttgctggtcgtaggtggccacgtccacggccatacggtgcacggtttgcacgtgagtgtccgcgcgtagcgcttcacgtccgatgagtgagaagccgatgcgtgcgccatagctgaggaacggtttgcccgcgctcacgcgtggacggatcgcctcggtggtgtgcgacgaaccgtaggcgatcacggcgttcgcttcgccgatcgccacgtcttcaagctctaccgtgccgccgcgccacggcactatggccaatacgtcggcgagatccgggttgatctgtgtcagagaacgagcgaacagtacgggcatcagcggttcgtcgaacgatgatttgccgatgatcgcgcttttcgtcagcagactcatggtcatgctccatacgggaatgccgggaacattgctggaaaacacgtggaatgtcaagtccggcccgtacaggcgcgtgtatccgccggacttgttcggtcggtattcgtccagcatgcgcgggcttggcagttcgtcatcaagaaaacgcaatagttcgcgtctgcggaacatgcgcatgtaacgtttcagttcgatacgcgtcatcgtcgcgtcatagccggtgatggagggaatcagagactccgctatctggcgaccctcataatcgggattcgtccacaattccaccgcctcgccgatgatgtcgacgatgtgttcgacggaatatgctgccaatgtctgcgatcgattgcaacgcgttgtctcgcacaaatcttggacagtctcaggcgtgagtaccggataacgcaacgtgacctcaccgcggtcggtgagaacgccgcgtgtttcgaaatcctcaaatacgaagccgcgcggcgcatggaaaatgtcgatgacgctcatgcgtttgccgccatcacctcgtcgacggcgatggagcagccgcgtgcctccgcacccttcgcacgaccgttgagctcgtaaccggaatcggtgcgcacgccaagatcttcggtcagaatcgccagacaggaattccaattcgccaaatcgtaatgcgcgatcaccccctgctcgccatcggcgacaggcgtgagcgtcgccggatcgaggaacacggaacgaacccacgacggcgtcgccttcagataattcgacgaaccatccgtatagtacgacagcagattctgatcgtaaatctgcgaactcaactccgtcataccgtacatgttcacgcaatgcgtgcgtgcgacgccaaacacctcaaggaacttcgcatacaaatcatcgacggtcatatcggttttcgtactcttgaaaccaccggtatcgaaaacacgcgaatccttcgccaacgcataggttttgccccgctcggcaagatagtcaagcagatacagatacgcggacgaagcgcccatcagcatcaccggctcgccgtctgccaccgactgatcaaggaacttttccacaccagcgaagtccaaaccatcctcatggaagaagaagccgctgccctcgctgccgcactgctccaccgcacgcgtcagataacgggccaacgaaccattatgattcatctcccaggcaggggagagcaccgcgatacgcatgcgctcacggtcaggcatgatgaaatgacggaacgggccgatcatcgacgcatcccacacctcaagatcaggatgatagttgcgtccacgctgacccggatgcgtagtgccgctggtcatgaacactgcctcgcaatcatcttcaggcaccgaagtgagcgtcagcatcttgaacccatccaccggcatcggcggaatatccatccaatccgacaacatctgcggagtcaccctacgagacatgcaatacgcgcgatactgcatgttatgggcaaactggaaagcgaaaatcttatgtgcgagcgcgtcgaacgcctcatccggagcgacctcgcaaccatacttttcgatgaactcaagcacgtttgccttgacttcctgcgcgtcggcacccaacgacattgatgtcatatgcggtattcctttctataaacgatactgatattcgaaagcaaatcagatctgcgacggaacttcagcttcgctgtttcctttacgacgattgatcagattcggcaggtcgatcagcagtgccttgagaatcaccacacagaacgccccaaccagaatcgaattggagaagaacacgtgagcgccgccctccaagccgctcaacgcgctcggcagcgcgatgcccaacagcagggacaatccaatgaccgcctgggaacggtcgttcgactccaccttgcgcagcgtattgaagcccgtgctgatcaggcttgccgcggccggcaggaaaatgccgccgatcacaggggaaggaatcaacgacaataccgctccggccttcggaatgaaaccaagaaccacaaataccacgccggcgatgatcaccggcacacgggtacgggtcttgccctcatccgtgaccttaagcaacgcgacattctgcggatacgcggtagtggtgaaaccgccgatcatcgaagaaatcgcggaaccggcagcctcgccggccaaaccataacgaacctgacgatcctcaagcttgacgccctggatctcactggccgcctgatacacgccaagcgcctccataatcgcaaccatatatgcgatgaagaacggcacaaacaccgccgcatcaaagtcaaaaccgccatacggcataatctgaggaagaccaaaccaaggcttcgacgcgacaccggaaaaatcagccatgccaaataccatcgaaagcgcagtgccggcaaccagagcaatcagataggaaagcgccctggccatacccttgccgaactgggaaagcgccaccaccagcacgcaagtcacgatagacacggccaacgtcttcggatcggcaaaaccatcatcgccgggagcgccaccaagaaactcgctcaacgtgaaactcgacagcgaaacgccaaccagaaaaataatcacgcccgacactatcggcgcgaacagaaaacgcatcttctcaatcacacgggtcagacacagcaccaagaaaatcagcgaactgacaaaaatcgacgtaccagcggcagccaacgaaccagcagtgcccgcagcgatcatcaacgcatcgaacgcggcggacggaccctgcacaatcggcaaacgcaccaacctcgtggcctgaatcaatgtgaccaaaccagacacaatgaaaatggcattcaccatatttgacgacaacgccaacggcaagccaatggcaccagccacaaacaccggatcaagccacacattggacaccaacacatgctgcaaacccagcagcacattcttcggagtcaacttcttcgaacccgaaccaagctgctcaggcacctgcgacgcatcagacacgccaaatcccttctctttccacgaaacacacggccaaacaccagccgtcagcacagagaagacgcgcacgcgcaccgttcgtaacatccctacgcaggcactaccctgttcaggtcataagggtccgggcaaacgcccatctcagccacatcggctcccctgtactcttcggacaaccaccagcataacgacacgcatcgataccggcaaccaccacaacccaacacatatcctccacattttcccaagaaaaaacagtcttgacttttccgagtattcgttatatggacacgcgaaacgtatttgatacaggggcgcggtattctaaaccacgcattaaagaaccgcaagacttttcttgcccaaaaacattgaaggtggtttcggtgactttccacgccccgttagatctcacgatccatgattcccaaggtatgtacgatcccggcgccgagcacgacgcctgcggcgtgggtatggtcaccaccctcaacaagcgccccgaacgcaaaatcgtcgacgacgccatcgaagtgctcgtcaacctcaaccaccgcggagccgtaggcgccgaagaaaacaccggcgacggcgcaggcatcctcatgagcatgcccgacgaattcatgcgcgccaccgcaggcgtcgaactgcccgaagaaggccactacgccgccggcatcgcattcctcgaccgcgacatcgccacctccggacaacaagaacaagccatcgccaaaatcgtgcgcgaagaaggcctcgaagtactcgcatggcgcgtcgtacccaccaacccggacggactcggactgcaggcgctcgccagcatgcccgcgttcaagacgctggtcgtggccgaccccgaaggccagctcgcaggcatcgaactggaccgcaagaccttccgcatccgcaagcgcgtcgaacacgaggtgggcatctacttcgcgtccctgtccgcacgcaccatcacctacaagggcatgctcaccaccatgcagctcaagcccttcttcctggatctttccgacgagcgcatgaaggcgaagatcgccatcgtgcactcccgcttctccaccaacacgttcccgagctggccgctggcccagccgttccgccagctggcccataacggcgagatcaacaccatccagggcaaccgcaactggctgtccgcacgtgaaggccgcctaagctccgaactgctcggcgaattcaagccgctgctgccgatcgctaccccgggctactccgattccggcacgttcgacgaatgcctcgaactgctgcacctgtccggacgttccatgccacatgccatctccatgatgctgccgccggcatgggagaagaacgaccagcttgaccccgatgtcagggcgttctacgaatacaacaatacgctgatcgaaccgtgggacggtccggcgcacatcatcttcactgacggcacccaggtcggcgcgctgctcgaccgcaacggcttccgccccggccgctggcagcttaccgacgacggctacatcgtgctcgcatccgaaaccggcgtgctcccggagaacgccgaggaacacatcgtgtccaagggccgcctggaaccgggcaagatgttcctcgtcgataccaaggaaggccgcatcatcccggacgaggagatcaagaagtccctcgcgtcccagcatccgtaccgtcagtgggtcgaaggcaacaccgtcgagatgagccagctgcccaagcgcgagcacgtcaaccactccggccagtccgtgcaacgccgccagcgcgccttcggctacaccgaagaggatctgaagctgctgctcgccccgatggccaacaccggcaaggagccgctcggatccatgggcaatgacgcgcctatggccgcgctttcctcccgcagccgcatgctgttcgactacttcacccagaagttcgcgcaggtcaccaatccgccgctcgactgggagcgtgaaaagatcgtgacctgccttgaatccgccatcggtcccgagccgaacctgctggccgattccgaactgcatgccaagaagatcctcattccgttgccggtgctcaactccgacgagatggcgcagctcaagcgcctcgaccgcgccaagatcctcggcggctactataagccgttcgtcgtcaagggtctttatcaggtcgctggcggcggcaaggcgctgaaggaacgtctcgacgagatcttccaggaagtcgacgaagccatcgaaaacggatccaacttcctcgtgctctccgatcgcgactccaactacacgtggggaccgattccgtcgctgctgctcacctccgcggtgcagcaccatctgctgcgcagacacacgcgcacccagatctccatggtcgtcgaggccggcgatgtgcgtgaaatccaccatgtcgctctgctgatcgcctatggcgcggcggccgtcaacccgtatctggcgttcgaatctgtcgaagacctgtcccgcaagggctatctcaacgtcgatgccgaaaccgcggtgaagaacctgaccaacgcgttgtcgaccggcgtgctcaagatcatggcgaaaatgggcgtctccaccatcatgagctaccgtggcgcacagctgttcgaagccatcggcctgaacaaggacgtcatcgacgaatacttcaccggcaccacctcccgcgtcggaggcgtcggactcgacgaactggccgaagaggtcgccatccgccatcgcgtggcctacccgtcgcagtggaccgcccgcccgcaccgcaacctgcgcaccggcggcgaatacaagtggcgtcgtaccggcgaagaccacctcaacgaccctgaagccatcttcctgctgcagcagtccacccagcgcggtgactacgacatgttcaagaagtactcggcgcacatcaacgacacctccaaccgtttgatgacgctgcgcggcctgatgaagttcaagtccggtcgcaagccgatcgacatcagcgaggtcgaaccggccagcgagattgtcaagcgtttctccaccggcgccatgagctatggctccatctcccaggaggcgcacgagaccctcgcgatcgccatgaacaccatcggcgcacgttccaactccggtgaaggcggcgaatccgaagaccgcatcaatgatccgctgcgctacagcaagatcaagcagatcgcatcggcacgtttcggcgtgaccagcgactacttggtgcacgccaccgacctgcagatcaagctcgcccaaggcgccaagcctggcgaaggcggacatcttcctggcgccaaggttccgccgtggatcgccaaggtgcgtcacgcgactccgggcgtcgagctcatctccccgccgccgcaccatgacatctactccatcgaggatctgaagcagctgatcaacgacgcgaagatggccaatccgaaggcccgcgtgcacgtcaagctcgtttccgagttcggtgtgggcaccatcgccgcaggcgttgccaagtgccatgccgacgtggtgctgatctccggctacgacggcggcactggcgcggctccgctcaacgccatcaagcacgccggcaccccgtgggagatcggcctgtccgaaacccagcagacgctcgtgctcaacggcctgcgttcccgcatcaccgtgcaatgtgacggcgagctcaagacgggccgcgacgtggtgatcgcagccctgctcggcgccgaggaattcggtttcgccaccgccgcgctgatcgtcgaaggctgcgtcatgatgcgcgcctgccagaagaacacctgcccgcagggcatcgcaacccaggatcccgaactgcgcgcacgcttcaagggcaagccggaacatgtcatcaactttttcatgttcatcgccgaggaagtacgcgagctgctcgcccagctcggcttccgcaccttggaagaggccgtcggccatgtcgaatgcctcgaccagaacgaagcgatcaagcgttggaagtctgacggcatcgacctgagcaacgtgctcatgcagccgggaccggtgccgggaaccatcctgcaccagaccatcgagcagaaccacgagctcgacaaggcgctcgacaacaagctcatcgagctcgcgcagcccgcccttgagaagaaggagccggtgtgcatcgagatgccgatccgtaacgtgtaccgtacgctcggcaccatggtcggctacgagatcaccaagcgttacggcgaggaaggcctgcctgacgacaccatcgacatgacgttccatggtgcgggcggccagtccatcggcgcgttcattccgcgtggcgagaccatccgcgtgtacggcgaagtcaacgactacgcgggcaagggactttccggcggacgcatggtcgtgcgtccggaggcgggcatcaccttcgatccgcatgagaacgtgatcgcgggcaacgtcaccggcttcggtgccacttccggccagatgttcgtggcaggtcgtgcaggcgaacgcttcggcgtgcgcaacggcggcgccaccttcgtggtggagggcgtcggcgaccatggttgcgaatacatgaccggcggcaccgtcgtgatcctcggtcccacgggtcgcaacctcggcgcaggcttctccggtggccacgtgtacgtgctcgaccttgacatgaagcaggtcaacccggctgccgccgccaacggcgcgttgctgttcgaaccgctcgacagtgagtcgaacgaaatcgtgcacggtctggtcaagcagcatgccgaagaaacaggctccgcattcgcggccggactgctcgccgactgggagaacgcatccaagcgattcacacacatcgttccgaagcacttcctcgccatgcagaaggcgatgaagaacgccgaagagaacaacatcgatttcaatacgcccggcgtctgggaacaggtgtacgagcaggttatggaaggagcgcgctgacatgggagatccacgtggattcctgaaggtccgtacccgtcgcgaactggccgaacgccccgtcgaggagcgaatcaaggattggttcgacgtccacgccgaatccggcctgcagccttggaccaccgaacaggcggcccgatgcatggactgcggcacgccgttctgcatgagcggctgcccgctgggtaacatcatcccagaattcaacgatctggtgcgccaggagaagtgggaggacgcgtacaaccgcctgtccgaaacgaacaacttccccgaagtcacaggccgcatctgccccgcgttgtgcgaggcagcctgcgtgctcggcattcaccagccgccgaccatgatcaagaacgacgaatgcacgatcatcgatcaggcttgggaactcgactacgtcaagccattgcctccgcagcgcctgaccgaccagaccgtcgccgtggtcggctccggcccgtccggtctggcatgcgcccagcagcttacccgcgcaggccacaccgtggtcgtatacgagcgtgatgacgccatcggcggcctgatgcgctacggtatcccgaacttcaaactcgacaagagactcatcgaccgccgcgtggaacagatggaagccgaaggcaccgtgttccgcaccggcgtggagatcggcaaagacatctcatgggacgatctgcgatcccgctacgatgccgtggtcgtcgccatcggctccaccgtgccgcgcgacatgaagattccgggccgtgaactcaagggcatccactttgccatggaattcctgcccgacgcgacccgccgcgtctacggcgtcaagccagtcaacgacatcaccgctgaaggcaagcacgtcgtgatcatcggtggcggcgacaccggatccgactgcctgggcacgtccatccgccaaggcgccaaggacgtcactgtgctgcagatcatgccgcaggaaccaagcgaacgcccggccaaccagccatggccgaccttcgcgcgcctgtaccagaagacctcctccatggaagaaggcttcgaaacccagcgcgccgagtacgtgtacagcacggattctgtgaacttcgtcggtaccgaagaggaacaggccaaggtgaaggtggagcactccaccgctactgaaggcttcgtggccgatgagaacggacatgtgaccggtctcaaggtagtgaacgttgcacccggcgaaaacggaccgttcacccgtcagcccggcaccgaacgcgtgattccggctgatttggtgctcatctccgtcggcttcctgcacccggacaccaccacgctcgtggaccagctgcccgtcgaccttgacggacgaggcaatgtggcgcgcaacgacaagttcgctaccagccaggacggcgtgttcgcctgtggtgacgccggacgcggtcagagcctcgtggtgtgggccatctccgaaggccgttcctgcgcggccgccgtggacgaatacctcaccggcgccaccgaactgccggcacccatcgtcgcatccaaaaggccgatgatgctgccgcgctgaacataagcagttaacgtaacagaaaaatcgtccgattctccgccaaaacggaatcggacgatttttcatatccccacttcccggaacctcgaacaatacagacgtggcataaacgtccgaatgacgtgccgttcggcgaaaaaccggcagtcatgcagtaaagtgaactgcagcacatcgcaacaaaggagtgacccaatgccaaatcgtgcagaacgtcgagcgcaggcaaagaacaaccgtaggggagtgccgcagcagtacgaccaaacccatggccgcgcacgttccggaatgctggacgaataccagctgcaggaaaagtcccgccgactgcaagacggtaccgatggaccttggaagccgaccggcggcaccatcgaagaaaccgaaagcctgctgaccaccagcccgaactacacgaacccgaagatgttcaaggcaccgcattccgcacgccaatggttccgcgtgatcagctggctgctcatcgcactgtccgcaatcgcattcctggtgatcatgtggctgccgtcacatcccatgtggttggtcgccacggtctccatcgtcttcgctgtcggtgtgcttagcctgttcttcacggcgggtaacccgaagcataatccgaacctcgatcagaatggtacggccgtctgatagcaaggcgatgaacgtaaagcggggctgcatccgatggaaggatgcagccccgctttcacatgcgagtcacgaatgacggcactattcgttcctggtttattgacctccttgcctgcatttttaggaaagatgcaaaactttgtgacacgaatgaaacaatcaggcgtttcattgaaaaattgccttacagtagtgatggaacaactgcctgactcgaagaggagagcacagatatgaaggttgacatcctttcccgtgaatatccgcccaaggtgtatggcggcgcaggcgtgcacgcggaggagctttccaaagttctggcggaacgcgtggatgtgacggtccgtgcgtttgacggaccacgtgccgagaatgagattcccgaaatcccgggtgacaatccgaaaggttcgctcaaggtcgtcggatacgacgttcccaaggaactccaggaagcaaacggcgcgctgaagacgttcggcgtcgatctgcagatcgccgacgatgtggacgccgacattatccacgcgcacacgtggtatgcatgcttggccggataccttgccaagatgctgcacggaacgccgctggtcatcaccgcgcattccctcgaaccgttccgcccatggaagcgtgaacagctgggtggcggctacgatttgagctcgtgggccgagcgtgacgcatacgagcatgccgaccgcgtgatcgccgtgtccgcaggaatgcgcgaagacatcctgagcgcctatccgaatcttgaccccgacaaggtggtcgtggtgcacaacggtatcaccatgagccagttcgaaaccccatccgacgacgatccgggctggaaggtgttcgaacgctacaatatcgaccgcaacaagcccacgctgctgttcgtcggacgtatcacccggcagaagggcctgccatacctgcttcgggcgttgcatttcgtcgatccgggcatccagatcgtgctatgcgcgggcgcgcccgacactccggagatcatgaacgaggtcaaaaccgcgttcgccaagcttgacgaggagcgcggcaacatcatctggattgaggagatgctgccgaagccggagctcaacgcgcttgagcacggttgcgacgcgttcatctgcccatccatctacgagccactcggtatcgtgaacttggaggccatggcgtgtggccttccggtggtggcctccgcgaccggcggcattcccgaagtcgtcgtcgatggcgaaaccggatatctcgtgcctgtcgaccagctgcacgacggcaccggcactccgaccaatccagacaagttcgtgcatgacatggccgacgctatcaaccgcatcatggccgatcctgaaaaggcgaagcagatgggacaggccggttacgagcgtgcgcgcgaccacttcagctgggagtcgatcgccgacaagaccgtcaaggtctatgaagacgtgcttgccgagcagggcaaaaccgccgaataaccagttcaccacgtagacgatgcgtggaacgccttccgctgaaagcattatgctggcggaaggcgtttccatatctacaagccgaacaacgataggggaggaagaatgccggagcagaacatcgcactggaactcgctgacgtggaatttcgtcgccgtggacgcgtgattctcaccaaggtcaatctgaaaatcaacaagggcgagaaatgggtgctgttcggacccaacggcatcggcaaatccagcttggttcaaatgatgagcaccagaggattcccgtcggaaggcaccgtcgacattctcggcaatcgcttgggcaaggtcgatgtgttctcctatcgcaaccgtatcggtttgagctccgcggaactgagtcgcgcgttccctccccaagaagatccgctcgacgccatcgtgaccgcattgaccgcgaccaccggccgttggcgcgacacctacaccgacgaagactatgccaaggcgcgttccctgatgcgtgaattcggtatcgaatatctcgaaggtaaaatgatgttcaaactttcggaaggcgagcgtacgcgcgtgctgatctgccgtgcgttgatggctgatccggatctgctgattttggacgagccgactaccggtcttgatttgggcggtcgtgagattgcgcttcgtgcgttgagccgtgtcggcgccgagcagtcggatcgtgccgtggtgctggtgacgcatcgtcttgaggagattccgcagggattcgaccatgtggcgatcatgggcaggatcaccggcagcgaggccgacgcctacgccgacaatgtcgcaggcaacgatccggctccgggcaccatcgtgtactcgggtgatctggaacacggtttcacttcggaacggttgagcgaagtgttcggtttggagcttgaggtgacgcatgcgaatggacgttggagcgcgtacgcgcggtaacgggtgctgtgtgcgccggaatatgctgtagcatgaatagcgtcggacaggagtcattcggttccgtgctgtcgtgatggtggaatccgtgtgggtatgaaggagtgattgatgcgtcgaggaccgttgacggcgggtgagaaggtacagttcacggatcgcagatccaataagatcaccgaccaattggtgccgggcggtgtgacgcagacctcgcacggcatcattctgcatgacgatgtgatcgggcagtcggaagggtccgtggtggtgacggtgagcgccaaacgtgaggcgcagatcaatcaggatcatccggaacgcgacgccaacaagccttggaagggaacgcgcgccattggcggatggcagttcgcggtgatgcgccctcggttggccgattatgtgctgtcgatgcctcgtggcgcgcagatcatgtatccgaaggacattgcccaagtgattcagcttggcgacattcgttccggcatgaacgtgttggaatccggtgccggatccggcgccatgagcgtcaacctgctggacgcggtgggggagcgtggaagactgaccaccatcgagatgcgttcggaattcgcccgcgtggccgaagcgaatgccacggtctatttcggtgggcgccccgcatggtgggatctgaaaatcggtgatttcgattcggtcgccgccacattgccggagcattccttcgaccgcatcatgcttgacatgcttgacccctggaaccgtcttgagcagtcataccgagtgattgcgcccggcggtgtgctcgtggcgtatgtgaccactactacgcagctaagccgtatggcggaggcgttgagggaggctggctgctggacggaaccggatatccaggagactctggaacgcgactggaaggttcagggattggcgatacgtcccgaccatcagatgatcggacacaccggcttccttatggtttcgcgggctatggcgccgggatttcaggcgttgcgcaagcgtgaccgtgccacgaaagacacgaccaccgatattgattcgctgagcgccgaagaacgtgccgaacagctcgaagatcttgagttgcgggatatttccgatcgcaagttgcgtaaggtgctgcgtgatctcgacgcgcaggtcgaggctatcggcgattgatacggtgtttcttgccgttgttctgagacaatagtcatagcgcgttgcgttggtacatacgctggatcgttaaggattggagcattcgtccatgggaacgagcctcaagaaggttgcgaaaaaagccaaggattacaagtatgtgttgctggtgatgcgtcacgccaaaaccgagccgtttggtgacggtggcgacgccgggcgtgagctgaccgacaaggggcgtaagcaggcgaaagccgtcgccaaaggcctggccgcgcacaagatggtgccgacgcgcattgcgtgctccagcgccaccagggctaggcagacctgcgatcgcatgcttaaggtgttcggcgacgacccgaaggtcgactatcgtcagagtctgtacgaaggtggggtgcagtcggtatttgacgagcttgcccagaccaaggagaagcatcgcgagctgttggtgctcggccatgagcccactgtgtcgatcgcatgccaatggctggcgagctccgaatcggatgcaatgctgctcgacatgctgaatctgggcatgtcgccggcatcgctcgccgtgttcggatcaaatgagccattcaaccaatggcagctgcacagtggcgaactcatcgcattgctgacggccaaggattttgaatgattccttcgcctctcgacatgatgctgagaggcgtgaaatgttgccatgccaactgatataaatcgtgctaataacgacacttaaattttcttgatgagttatagctggcgatttcgtggtagcttgagcgggttgcattgttcatatcagatggaggattcatgtccgttctcacttccgtctccggtttccctcgcatcggccagaaccgcgagctgaagaagattatcgaagcttattggaagggcgtcgcaacgctcgacgacgtgcgcgctaccgccaaggagctgcgcgccaagcattggaagctgcagcaggaagccggaatcgatttgattccgagcaacgacttcagctattacgaccaaatgctcgacactgccatcctgctgaacgtcattccgcagcgctaccagcgcctcgccttcgacaatcccgaagagacgctgttcgccatgggccgcggctaccaaggagacaagggcgacgtcaccgcgctgccgatgaagaagtggttcaccaccaactaccactatctggtgccggaagtcgacgaagccaccgacatcaagctcaacagcaccaagccgttcgacgaattcaacgaggcgaaggcgctcggcatcaccaccaagccggtgctcatcggcccgtacaccttcctcaagctcgcccgcaatccgcaggccgaagaactcgaatacgacaagggcctggtcaacgcgatcgccgccgtctacgccgaggtcgtggccaagttcgccgagctgggcgccgaatggatccagatcgacgaaccgtacctcgtgctcgacaaggagccgggcgacgtcgaactgttcaagagcctgtacaccaagatcctgcccgcacgcgacggcaagatcaaggtgctgctcaacacctacttcggccacatcgccgacgtgtatgagaccgtcaacctgctcgccttcgacggcatcggactcgacctcaacgaaggcaaggacgagaatctcgccgccgttgaaaagttcggcgtcgcagagagcaccaccatcttcgccggtgtggtcaacggccgcaacatctggcgtaacgattacgccgtcagccttggactcgtcgacgcgctgaagaaggtcaccgacaacgtggccgtctccaccgcaagctccctgctgcatgtgccgttcagcaccgaaggtgaagacggtctcgccgatgatgtgcgcaagcatttcgccttcgccgttgaaaagctcggcgaactgcacgacctcgcggttctcgccgacgccagcgaggaagacaagaaggcatccggggcattggcagccaaccaggcgctcttcgacggtacccgcgtcgccgccgacaagaacgtggcggaacgtctcgcagccctgaccgactcggacttcgtgcgccagccggcacgtgccgaacgtcagaaggcacagcgggaggcgttgaacctgccgttgctgccgaccaccaccatcggatccttcccgcaaaccaaggaagtgcgcgccgaacgcgccagactgcgcaagggcgaaatcaccaagactgaatacgacgaatacatgaaggcgcagatcgacgcctgcatcaagcatcaggagcagatcggccttgacgtgctcgtgcacggcgaattcgagcgtaacgatatggtcgaatacttcggccagaacctcaacggtttcctgttcaccaagaacgcttgggtgcagtcctacggcacccgttgtgtgaagcctccgatcgtatggggcgacgtgtcccgcgccaacccgatcaccgtggaatggagcgcctacgcacagtcccgtaccagccatgtgatgaagggcatgctcaccggcccggtcactattctcaactggtcctggccacgcgaggacatcacccacgagcagcagacccagcagctggccctcgccatccgcgacgaagtgctcgacctcgaagccgcaggcatcaaggtcatccagatcgacgaggccgccctgcgtgaaaagctgccgctcaggaagaccgactggcacaagaagtacctcgactgggcaattccggcattccgactggtgcactccgcggtcaagccgaccacgcagatccacacccacatgtgctactcggagttcaacgacatcatcaccgacatcgacgccatggacgccgacgtgatctccttcgaagcctcccgcggcgatctcgtggtgctcgacgccattcacgacgccaacttcgaaaccgaagctggcccgggcgtctacgatatccactcgccgcgcatcccgtccgaagccgaaatcgaggaacgcatctacgaaatcctcaagaagatggacgttgaaaaggtgtggatcaaccccgactgcggtttgaagacccgcggcaacgccgaaacctggccaagcctcgaaaacctcgtggccgcagcccaggctgtgcgtgccaagctgaccaaataaggcgaaacgttaggaacaagacgacagccatgcattcgccaatgttctcgctcgaggtgttccctccgaagcgaacctcccctgtaggcaccatctacgacacgttggatggcctgcaggggttggaccccgatttcatttccgtcacctacggcaccggcaaatcatccgaccgtacattgaccgcgcgcatcgcccacacggtaagcgaatacggcatccccagcgtggcccatctgaccgcgcagtatctgaacaaggatgacgtcgaccaggcactcgacatgttcgaacaggccaaggtctccggcgtgctcgccttgcgtggcgaccgcatcgacggtgccgaaccggcaggagtattcgaacatgccagcgatctggccgtatacatccgccagcaacgtccggacatgaaaatctacggcgcctgctacccggaaaagcacccacagtcggcaacgctggaagaggacatcgacaatctcaaaaagaaagtcgatgccggcgtgacgcatctgatttcacaactgttctacgacaacgaggacttcctgagattcctcgacaaagcgagggctgcgggaatcgacgtgccgatcgaagcgggcatcatgccggtcatgaacgcgaaatcggtgctgaacatgtcgaacaaatgccagtcgaaagttcctgaaaaactcggcatcatgctcgataaatggggaggtgacaaggctctgctcaaagaagcgggcatcgcctacgcatccgagcagatctgcgaactggtggcgcggggcgtcgacggcgtgcacctgtacacgatgaaccatccatgtgtcagccgacgcatttggtccaacgtcaaaccattcttcgtctgatttcaggcgatgcaacaaacatcaagggtggttgcgggtatttcgcaaccgcccttggttttatcagcggttactatagaaaccatgacttccatgcaacacaagttcggggcgcttgatctgattcgagcagggctgcaagatctcgacagggctcgcacgttgttcgacgagctgcacaatgacggcatcgatgacgacaggatgcggctgctactagccacgctggaaaaagcgtgcgatcccgacatcgcactcagcaacctggtggacatcatcaaagtgatgcaaagtcaaggcaaggatttcaccaacatcatcgccgatgaaaactctttcgtgcgactgatcaccgtgctcggcgtatccgatgaaatgggcaagctcatgcgattccgcccggaactcgtggaagccgcagccaacgatgcctgtgaaagccatctctacaatcacgaacagcgcaaagcgcatgtgctcaaatcggtaggtgctgatcccaatgaccatgccatgccgaccgcaagcctgccacttgccgaagctgcgacggcgctacgtaaaacctatcgcaaacaactcgccgcaatcatggcgcaagatgccacggcgaacgatcccatcgaaatccaaccgcgcatcagcaccgaactttccgaccttgcggacgcggcgcttgaaggcgcgctcgccatcgcgcgccatgaagtggacggcagcgaacatgtgcgtttcgccatcatcggcatgggcaaactgggcgcacaggagctcaactatgtatccgacgtggacctgatctacgtggtggaacccgccgacatggacaccaacggcatggcactcagccgaatcggcaccaaaatggccaccacgctgcaacgtgtatgccaatccgtcatcatgggcgtcgcagaaccgacactctggcagatcgacggtggactacgccccgaaggcaaggacggtccgctggtacgcagactcgaatcccacgaagcctattacgagcaatgggcggaaaactgggaattccaggccctgctcaaagcccgcccggtagccggcgacaccgacctcggacaagcgtatatggatatgacccgaccgttcgtttggacagcttccaagcgagacaacttcgtctatgactgccagcagatgcgcaaacgtgtcgaagaccttattcccaacccgctgaaagaccgcgaaatcaaactcggcaggggaggcttgcgcgacgtcgaattcaccgtgcagatgctccaactcgtgcacggccgctccgacgaagcattgcgtaccagctccacactcgaatccctgcaggccttggccgaaggcgggtacgtctcacgcaaacaagccaagaaactttcatgggactaccgattcgaacgtgtgatggaacaccgccagcaaatgtgggcgctcaaacgcacccacctgttcccagacctcggcaaagccaacgctggcggtcttgaacgcaaacgagacatcaccatcgacgagctgaaccaaaatcccgaactacgtcgactcgcgcgcgcatttcacatgcatcccgaagaactcgtcaacaaatacgatgagacacgtcgtgaggtgcgtcacctgcacatggacatctattaccggcccatgctgcccatcaacgcgggactcgacgacgaacaggtggaactctccacgaaagccacgcaggaacgattcgaatccatcggattcgccgatgccgacgcggccatgcggcacgtcaccgcgctcaccgcaggcatctcccgtgcggcaaaaatcaaccgcatcctgctccccgcagtactgcaatggctcggcgaagggcagaatcccgacatgggactgcttaactggcgcaaacttgaagaaaacttcggctccgaaagcggatacctcggattcctacgcgattcaccatccgcggcacaacgcctatgccacgtactatccaactcacgattcctcggcgacgcactcaacaaatccgtcgaatcagtcacatggctcggcaacgacgactctttgcaaccacgttcgcgagaaagcctcgacattcaaaccaaggcgacgcttgaacgcaatgccggcaacatcaacgatttcgccaactccatccgagccatgcgcagacacgaaatcgaacgcatcggtctcgcttggatgagtggcgtgatcgacgatgaagcatcgctcgccggcatgaccgacgtatacgacgcggccatcgaagcatcgctgcagtgggccatccagcatcgcatcaacgacatacagatcgacgaagctccggcggcgatcgccatcatcggcatgggacggtacggcggtagggaagtgaacttcagctctgatgctgacgtgatcatcatctacaggccggccgaaggtgccgatgacgaccaagccaaccttttcgcacgaaaagtgcaggaagacctacgtgcgatcctgcaaggtccaaccacattcgaaccaaaaatcgaacttgacatggatcttaggcctgaaggcaaaaacggaccgctcgtacgttcctacgcatcctgcgaggaatactatcgatcctgggcaagcacatgggagcatcaggcgctgttacgcgcacgatatgcggcaggcgacgcgtctcttgccgaggatttcctcatgaacatcgccgacccgttgcgttatccgaaaatcgatcttacggaaacgcagatcgccgaaatccgcaaactcaaggcacgtatggaagctgaacgtctgccgcgcggagtacgtagggatcgccatctgaagctcggcaagggcggactgtctgacgttgagtggacgatccagttgctgcaattgcagcatgcgggagacaatgccaacttgcgtgtcaacggtacgttgcaggcattgaacgagttggaacatcgcaagctgatttccgctggcgatgctgtggtgttgcgtaaggcatggcgtatgtgcacggccgcgcgcaacggcagttatctgtggagcggacgcgtcaatcaggctgatattttgccggacgattcatattcgctgggaggcatcgccgtgtatctcggttacgatgcgaatcgcggccaacatttcgaaaacgacctgctcgccgtgatacgcaaagcccgtgacgtaacggaacgcctgttctacggtcgttcgtgagtcgtgccatttgaacggctaggagcatggtgtggccgtcggaccgaagttatacggctctgacggttatgctgattcagggtttcgtgcatggaaggatggaggttgcgccacgaatacttgtgaacacgcggtgaactggcagggtctgcatttcaggctatagttggctaggtcacttcgagtggccaccttcaaccacaagttgcatgaaaggtgagccgttgtcttcagtactcgaacaggcggttgaaacgccgatggtcgggaaaagcgtcatcacattggatgatctttccattcgccagattcaggaattactccacaaggcgcagtacattgattctcatcgtaaagaagtggcgcacacctgcgatggcagggtgctcgccactttattttatgagcccagcacccgtacgcgtctgagctttgaaaccgccatgctccgactcggcggcaaggtgatcggcttcgccggcgcccagctcgcttccgtgaccaagggcgaaaccatttcggacaccctgaaaaccgtgtccaactacgtggacgtggtggcgatccgccacccgaaggaaggcgccgcgctcgtggcgtcccgtgcagcctccgtgccggtcatcaacgccggcgatggtggacatatgcaccccacgcagactctggccgatcttgcgacgatgcagtcgcgcttcggtcgcgtgaacaatctgactgtcggactgtgcggcgatctgactttcgggcgcaccgtgcattccctgatcgaaaccctgtgccgtttcggcaacgtgaacttcgtgctgatcagcccggatgagctcaagaccccgcagtatgtgctcgaccgcatcaacgccaccgactcctgctcctacacggaagtcaaggatctcgtttccgtgatcggcgatctcgacgtgctgtacatgacccgagtgcagaaggaacgcttcttcaacgaagacgactatctgcgactgcgcgacacctacattctcgacgaagccaagatggcttacgccaagaaagacatggccgtgctgcacccgctgccgcgagtcaacgaaatcgccgtcgaagtggatgacgacccacgcgctgcctacttcgaacaggtcaagaacggcatgcttatgcgcatggcattggaaagctcggtggtcggagacgaactgccgggatatgaaccgcttgaatccaaggaggttgcagcctgatggaagtcaccagcattcagaacggcatcatcatcgaccatgtgcctgctggcaccgcgctcaaggtgctcgaatacctgaaaattgatccggctaagaccaagctcgcgctgatcatgaacaccgacagccacatgttcggcaccaaagacatcatcaaaatcgaaagcgaagaggaagccgaaaccatcgaccttgacgtgctcggccttgtggcacgcaccgcaaccgtcggcattgtgcgcggcggtaaaatcgtagagaaaaagcagcctacactgccggaacatgtggtcaatatcatcaaatgcgtgaacccgcgctgcgtgactaccaccgagccggccgtacagatgttccacctggtgcattccgaccgtcaggaataccgctgcgactactgtgacgaggaagcgaagttctgacccatgaccctcacccttcacgacatcaaggtttggaacaccggcgaagtcatcgacctgatcgtcccatctgacgctgatgaaacggtggacgcttcggccatgaccatcgccccgggattcgaagatccccacgtccacttccgcgatccgggccagacctacaaggaatccatggtttccggttgcgcggctgccgcctctggcgggtatacgaacgtgctcatcatgccgaacaccgttcccgccatggatggcgtgaaggtgacggcgggggaaccgggcgccagtgaagtgctcgacgccggtttcgacacggtcatcgactatttgcagcattacgaacaagcccatgatgtgaccttgccggtgcgttatgacctgtgcgtatgcgcttccaaagggcgtgcaggcaaggaagcaaccgacgtggccgactggatcggctacctgcctgaacacgatgacgacaacaaggacgcctaccagctgtgccacccggtgaccgccatcagcgatgacggttccgcggtaacaccggaaatcctcgaccaagtgttcgacaacgtcaagaaatcaggcttatacctgatcgagcattgcgaacaccacgacaccggggcggtcaatgaaggtcccgtatcacgagaactgggcgtacccggcattcccgaagataccgaactgaaaatcgtcgaacgcgatatcgagatggcgcgcaaaaccggcgtgcatgtgcacttccagcatgtcagcactgcgatttctttcgacgcgattcgcaaggccaaagctgaaggcttaccgatcacgtgcgaaactgcaccgcactacgttgcgttgtgcgatgaagcattgctgaaatacggcactctcgccaagatgaatccgccgttgcgctccgaagaggatcgcaaggcaaccatcgcagccgtagctgacggcaccgtcgatctgctggccaccgaccatgcaccgcataccatggaagagaaggaccttggtttcctcgatgctccgaacggcatcattggtcttgaatgcgcgtatggcgtatgccacaagattcttgtggacggtggctttatctccgacgaacgcctgattgaactcatgtcgactgcgccagccgaacttatgggccacagcaaggccgacgtcacagcgttgcttgacgaatacgcagacgccgtccccggagacgacgacaccaaacgcgtgctggacctcgtcaaggttcctgcagaagaccgcgcggatctggtggtgctcaacaccgacgaggcatggaccgtgaatcctgaacgattccattcctcggctcgtaacaccccgtttggtggatggcaggtcaccggccgtccgctcgccaccatcatcggctcgaaactagtcttcagccgtatcaacaaggaggattgatggatcgcctgatcgaagcaatcgaagccaagcagaatccgagcgttgtgggacttgacccgaccgaagcgctcgtgccagcgcaaatcgtggccggctttgccgaggaaatcagcgaacaggttgaagatccggcggaagcgccgtccatgcagctttccgtggccttcttcgaattcaaccgcgccatcatcgacgccgtcgcagacatcgtgcctgcggtcaaaccgcagatcgccatgtatgagacgctcggtccggcaggcatcgacgcctacaccatgacctgcgaatacgccaagcagcagggcctgtacgtgctcggcgacgtcaagcgcggagacatcggctctaccgcggctgcatatgctcatcacctcagcggtataggattggacgacaccgcctatgatccatggcatgaggatgcggtgaccgtgaacccatacctcggcaccgatggcatcacaccgttcgtcgacgccgccaccgccaacgacaaagacattttcgtgcttgtacgcacctccaatccgtctagcagtgaactgcaggaacttgaactcgcctccggtgaacgcgtatacgagcatgtcgccgatctggtggaaggctggggcgccgaaaccatcggcaagaacggctattcacgtgtaggcgcagtggtcggagccacgcacccagaggaaggcaaggcattgcgcgcacgcatgccgcacacgttcttccttgtaccgggatacggcgctcaaggcggcaccgcgcaaggtgtggccggcatgttcgaccgtgacggcatgggtgcgcttgtcaactcgtcacgtggcgttatcggtgcatggaaaaagtccggcaagtattctgaatccatgagcgccgacgatgctctggatctggttgcggaatcagcccgtgaggcagccaaagatatgcgtgacaatctgcgtgcggtcttgccgtaacctgccgactggccaactgttcaatctgaaagaaaaacaaccaccaaaccatcgaacgtaacagagagggagttcatgaccaccgcaacaacgttcgttccgaccgttgccgaagcgactgcggcaggctttttcccgagccggcatgaagtcgaggtcgttgacaatcaggaactgactgacggcgtgtaccgtttgacgttccgtgacgaatacatcgccagccatgcaaagccggcacaattcgttgacgtatattccaacgatccaagcaagctgatgccgcgtccgttcggcgtttgcgaaaccaacggcgacgaagtcagcctcatgttcgccgtggtaggcaagggcaccgcagaatttgccggattgaaagctggggacaccattcgtgtgatgggcccgctcggcaattcgttcaagaccaaggagcccgccaattatgtgctcgtggcaggaggtcttggcgtgcctccgctcgtgcatgcggcacagcatatcgccggcatcgaaggcgcggtcagcaccgcggtgttcggctaccgcaacgtgcgtttcggcgacgaatatgcgggcaagtatgccgacaaggtgtacagcatcgacgagagcgaaggcaacgtgatcaccttgcttgaccgcatcgaaggcgagttgatggattcgggactcaagccggtgattctgacctgcggtcctctgccgatgatgaaggccgtcgccgcatgggccgtgaagcgtgacatggcgtgccagctgagcttggaacagcgcatgggctgtggctatggcacttgcgtgctgtgtacggtcgacacgttggacggacgtttgaaggtctgctccgatggtccggtctttactcgcgaacgtttgggatggggtgaatgagatgatcgacgatacccagcatgagaacctgtacggttcgtacgagtggaagcatcccacgcaggtggcgggcgtgccgtggaagaatccggtcgccacggcttccggcaccttccagtatgcggcggtccgctggttctacgacgtgagccaactgggcgcggtcaccaccaagggcgtctccccggtgccatgggaaggcaatcccggcattcgtaccgctgaaggcccatccagcaacatcaacgcggtcggcctgcagaacccgggtgtggaccattatttggaagacgacctgcccaagctcaaggccatcaacgccacggtcatcgccaatgtggccggtcactgcgacgacgactatgtcgaagtcgtgtccaagctgaatgattctccggcagacatgctggaaatcaacgtgagctgcccgaacgtgtccgccggaggtatgagcgtcggcactgatccggtggcgttgagccgtctgatcacccgcctgcgcaagctcaccgacaagaagatgattgtcaagctcacgccgaacgtcaccgacatcaccgtgcctgcccgcgcggccgtggaaagcggcgccgacgcgctgagcatgatcaacacactgctcggcatgcgcatcaacattcgcactggagaaccgatcatcgaccatgtgaccggcggcgtttccggaccggccgtgctgccgatgggactcgtggccgtgtggaagacccgctccgcattaccgaacactccgatcatcggcatcggtggcatcgattccggtgagaaggcgcttgaatacctgtatgccggagcgaacgccgtggaagtcggtgcggccgcactgttcgaaccgaccgcgccattgcgtgtggcccgcgaactcgacgagctgctcgacgcacgtcccgaactcgcagacaagctcgccaagggcgaaacttggcgttgacctcgatcattcatcaaaggagcatgacatgactgaatccctcgaccaccgttttaccaagttcctgctggaagcgcaggcgctgaaattcggcgagttcacgctgaagtccggtcgtaagtcgccgtatttcatcaatgcgggcgcattcaacgacggacgtaagatcgccacgctcggcgcattctatgcggagaagatcgcggcggaaatcgaagcaggcaatctgccgaacgacatcgacaccattttcggtcctgcctacaagggcattccgctgggcgtctccaccgcgatcgctctgacttccggccacggtatggaagtcggctacaccttcgaccgcaaggagaagaaggatcatggcgacggcggcatgatggtcggcacccagctgaccgacggcatgaaggtactgctcgtcgacgatgtgatgaccgcaggcaccgcagtacgcgaggtcattcccaagctcaaggccgaagcggatgtggaggtcgtcggcttggtgctttccgtggatcgtatggaaaagaccaaggattccgacacgtccgcggtgaaggccgtcgaagcagagttcggcttcccggtattcgccattgccaacgtgcgcgagatcttcgaggccggccagcatatcgaaaccgctgacggcaccgcgtatgtgaccgacgagatcaaggccgctgccgacgcttatctggagcagtatggtgcctgaattctataggcgggtcctatagttgacatatgaaaagtgcctcacaccaatcgaaagcatcggtgcgaggcacttttcaatctcatatcagagtgcattcagtcgatcaggttgtatccatggtcggccaccaccgacttgagcttctccaaatagttttccgcggccttcgacagcttcgcacgctcgttcgtgatccagccgaccagcatggtctcatcagagtcaagcggcacggtcacgattttctcattgttgagatcgccgttgtcgatgccggtgcacacggtgtagccgttcagaccgatgatgaagttcagaatcgtcgcacggtcggtcacgttgatctgcttgggggagtattccggccagaccgcctcttcggcgaagaagaagctgccctcctcgccctgctcgtactggatgaacgggaacggcttcaagtcgtccatcgtgactttcttcttgccggccagtggattgttgcgtgaaatgaacacatgcaacggagcacggaacagtggatggaattccaaatgcttttcgcgcaacatcttgccaatcacgtctttgttgaaatcggacaggtagatgatgccgatttcggaaagcatgttcgccacttggttgatgatgtctttggtgcgcgtctcacgaatggtgaactcgtattcgtcggatttgatggagttgatcatttccacgaacgcttcgacggcgaatatgtaatgctgtgtggacacggaacacagctgcttgcgtggcttcgcgttcttgtaacgttcttcgagcagcgacgcctgatcgagcacctggcgcgcgtaggtgaggaattccgctccgtccacggtcaaggcgatgccttgcgacgagcgggtgaagatctcgatgccaagctcgttctcgagttccttcacagacgagctcaacgcgggctgtgacacgtacagctcgtgcgaggcttcgttcatggaaccgcattccacgattttcacaatatatttcagctgaagaagagtcataaattcaggttagagccatgtactgaccgtgggggagtgcttataccctcttgtctggatagtggactgccgatcgcgcagatcaaggacgtgaaaaaccaattgcagcttgacgaggatcgcacacagttggaaaccccacaaaccgtgctcgacaaaaccggtcaggtgttcgcccaatgggagcggaccggcttgacgggtcaggcctacaagcaaaagagttgtccctatcggagtgctccatatcggcataagcgacaaaaagggattgcccggctttctacacaccagacaatcccgttcatcacaacctactacagttcggtctactggtacagatggccgccctgctcgcggaagcgctcgctcatctcttgcatgccggcagcgatggtttgcgcgtcggcgacgagcttctcctgtgcttcggcattaccgaattttttgcggatgttttggctgatggccatggagcagaacttcggaccgcacatcgaacagaaatgcgccatcttcgcaggctcggccggcaaagtatcatcatggaacgcgatggcggtgtccggatcgtagctcaggttgaactggtcaagccaacggaattcgaaacgtgccttgctcatggcattgtcgcggtcgatggcatgcggatgatgcttggcgatatcagccgcatggcaggcgatcttgtatgcgatcacaccttgcttcacatcgtccttattcggcagcccaagatgttccttcggcgtcacataacacagcatggcagtgccatagcgggcgatttccacaccgccgatcgccgacgtgatgtggtcgtagccgggagcggtgtcggtggtgagcggtccaagcgtatagaacggcgcgtccttgcagatcgccttttccatctcgatgttcatgcgcacggtgtcgaacggaatatggccgggtccttcgatcatcacctgcacgtcgtgttcccatgcgcgctgcgtaagctcgcccaaagtcatcagttcggcgaactgtgccgcatcgttcgcatcggcaagcgatcccggacgaagtccatcacccagtgagaatgcgacatcgtacttggcgaagatctcacacaactcatcgaaatgcgtatacaggaagctttcctgatgatgctgcaaacaccattcggccatgatcgaaccgccacgcgaaacgatgcccgtcatacgattcgccgtcaacggcacgaaacgcagcagcacaccggcgtgaatcgtcatgtaatccacgccttgctcgcactgttcgatcactgtgtcgcggaacagttcccagctgagcttggacgcatcatcctccaccttttcgagcgcctgatacattggcacggtgccgatcggcacgggggagttgcgcagaatccattcacgagtggtgtgaatgtcgttgccggtagacagatccatcacagtgtcggcaccccacttggtggcccacgtgagcttctccacctcctcgtcaatagacgaagtgaccgccgaattgcccatattggcgttgagcttggtgaggaacttcgagccgatgatcatgggttcagcttcgggatggttgatattgcaaggcatgaccgcacgccctgcggccagttcgctgcgtaccaattccacgctgcaatgctcgcgctccgccacatagcgcatttccggcgtgatgatgttgtggcgcgcgtaccacatttgcgtcaccggatgatccttggccttcatcggcttatgctggcgaccacgccattccttggaagccttgccacgtttgatggcgcgtttgccgtcatcttccaaattgcggcgacgtccttcatattcttcgacgtctccacggtcaagaatccagtccaaacgtaggggagcgagaccctccttcggatcgcatttcggaccttcggtgttgtaatccttgaatggtgcgttcggtccgacgccaggagtgtcagacagtttgatttcagtgtacggcacttgcagatcgtaggaaccgaattcgttttcgaaatgcaccggcgtggttttgcgaatatgtgctttgtctcgctgcttggaatcgcgtgcggcaatgtcgacgcgctgttgcttggcaagcttggaggcggccttggcttccttcgcattggtgaacttcttttcgccggatgcgccgtcggctgtgttgtcagtgttgatttccgctgttttctgggctttcacgcgcggcgcgtacccgtgcttcgtgtcgccacgtacggctttccagcgcgctaccatattgcgggttgcagcttccggatcatcggctcctgcaatcgtggacaccacgaaccagcctgccgcctttgaatgcgccagcatctccatatcatctgcggtcacgccaccgcctaccactaccggaaaaccactggctgaacaaatggtgttgatctgctcttcgtcaagcgtgcgaccggaaccgtcattgccgcctacggacgcttccggcttggtgacggaaacatgcagtggtgccgcaccgatatagtcgatgcagccgtcgggcaattcgttgatgagtttgaccaggctttccgtttcggcggacaagcccacgatggcatcttcgccaagcagtgcacgggcttcgcgcggttccatatcggtctgtccgatgtgcacgccgtcaaccttgatgcctttgctgcgggcctgccagaccacgtccacacggtcgtcgatcacgaatgccacggaatccgacttattgttgtcttcgatgatttgcgcgatatcacgcgccatgtcggtgagatccttcgcgtcagcgtctttgacgcgcagttggatgaagcttgcgcccccgcgcaatgcgtcatcgatgacgtcggtgatcggtcggcctttgcaatcctgtggtcctaccacaaaataggcgctcaggtcgaagctgtctcgcatcgacgcatacggataattgttcatgattcccccttgattatgctgttttgggttgggaaaacttgatttcgcaggcaatgggtatgctgacgcgcccgtatgctcggttatacgggatagaaaacggaattacgattgatgattgcgcgatgcagactgtttggtcgacgcgtctgctgcgcagacttttacggatgccaattgacgctggcaatgcgtgtgcgctacgacactcattcttcgctccctacgatggtgttaaccaacaggttcaaagggtcaggcattcgcctatctcagctccgttggggagcccccctgctttacgtgttggctatgaatctacgccctgcactggacgtaactttcatcgaagcccacaggagagttaggccagccgtcactttcgcatgcatcgcctccatccgcgtcacgcctccgccgcgcaactcacagcaaactctccttgcaggctaatctatacttcagttcaatgcattgcgtgtgaaagaggtcgactacatgttggaaacggaacgtctgacattgagggcttgggcggaaacagatgcggaaagcttgtactcctatgcgaaagatccggatatcgggcctatcgcgggctggcccgcacaccgatcgaaagaagaaagtctcaatacgattcgtcatgtgctcaatggcaaggaatgctacgcgatttgcgagcgcggcagcaataaccccattggttcgattgagttaaagcttaatggtcatacggatatgacggatcgtgatgatgagtgtgagttgggttactggctgggcaagcctttctggggaaggggttatatgccggaggcagccaaggaggttatccgtcatggttttgttgatcttggtatgagtgcgatttggtgcggttattatgacggcaatctgaagtcgaagcgggtgcaggagaaggttggttttgtctatcatcacacgtgtgatgaggtgccggtgcctcttatgcacgaggtgcgtgtcgggcacgtgaatgttcttaccaaatcacgctggcaaaatttagctgcctgctgattgtgctagaagctaacctagaatgctttggaagggtcttggtgggcttcgaacggatgctggtcaagaccctttagagcttcatgatgttttcctcgatgcgacggatgacgtcaatgaaagcttcatcgttgtgcccggttggatctggcagattccaattatcgtcgaaagccttgccgatatagggacatcccacgtcgcagcccatggaaatcgcgatatcaggttttggaatatccgaaatcagtttggagtattgcgttttttccatgtcgatgccgtaaagctctctcatgagtcgtacggcatcctgattgatctgcggcttggtttccacacctgcggaataaaaatcaaaatcggttccgcgtaaatgctttcccaacgcttcggcaatctggctgcggcatgaattatgcacgcaaataaaagccacttttctcatagcttcccctgtctgcgatgttatgatttcgcgattgctgttccgtattatacgtttcgcccaatgctccgcgtccacatcatcgaataacacaatgcccggtgcaaccatggcataagctggtcgtaccgggcattggcttggattattcgccccagacttcttcggcgatggaccttacgagtgcgatcttagcccactgctgctcctcagtgagcttgtttccttcctcagtggaggcaaaaccgcattgtgtggacaggcacagacgctccaacggcacatactgggccgcttcgtagatgcgagccttgatcgtttccggatcttcaagttccgacctcttggaggtgacgaggccaagcacaacctgcttatcaccggaaacctcagccagtggcgcaaagtcaccggaacggtcgtcgtcgaactccagatagtaggcgtccacgttctcttcgccaaacagcttggctgcgaccggagcgtaaccgccggatgacagccacgtggaatggaaattaccgcggcagatatgagtattgatcaccaggtcgtcaggctggtcagcgatcaccgcgttgatcacgtcgagattctcctgctgcaggcgagccgcatcttcgtcgctccagccgagacgctcacgcacgctcttgtcgcacaggcgagtccacgtgcaatcgtcgaactgcacgttacggcagccgacggcatacaggtcggcgatgacctgacgatatgcggccacaatatccgcggtcagctcgtcgtcatccttgtagaactcgtcgtacgggtaggcgttcttgttgccggtaagcacgaaacgggtctgcgctggggaaggcatggtctgacgagctacggtattgtcatcttcaaactgcttgacgaacttgaaatgctccacgaacggatgatcgtgtccgtcgagcttgccggtcaccgtggcagtgtcggcgggagtgacctcgtcatggaaggcaacgcgatgggcggcggcgacatggtccacgccattgaagccccacatgaaatcgaaatgccaccagccgcgacggaattcaccatcggtgatgacatgcaggccggcggccttctgcttggtaaccagatcagcgatcagcctgtcttcgacagccttcaacccggcggcatcaataatacctgcagcataatctgcgcgagcctgcttgagtttgtccggacgcagataagaaccgaccacatcggcgcggaacggcgcattcttggaatatgtcatgattctccttcgactattgacttgtgattaacaatcaaaatgacaaaaccaacaatatgctaccccaccacccacgaacgagacgcgcttctgctcatgttttcgaaggcgtggcttgttgcctctgtaactccctatatatggcagattcatatataatcacaacggacatgaacgactgcaaggaggctgccatgactgtgccgcaacgagtgcttgacactatgaattccggactgatctacacctgcgatgacgaagagatgatcaaagcgcagcaggaacagatggaactgctgtacgacttcaacgcaacccgccccagccaaatgacgcaacgcaacgaaatcgcacgccaactgcttggcgaattcggcgaggacgcttatatcgaaccgccgttgcatgccaattggggatgcaacacgtatttcagtgcgcacgcttacgccaatttcaacctcacgttggttgatgatggtgaagtgcatatcggcgaacataccatgatcggcccgaactgcactatcgttaccaccggccatccgattcgtcctgacctgcgcgagaaggtcacacagtattcgatgccggtcgtcatcggccgtaatgtgtggttgggcgccaacgttaccgtgcttcccggcgtcaccattggcgacaattcggtgattggcgcatgctcgctggttatcaaggacattcccgccaatgtggtcgcattcggacagccatgcaaggtgtatcgagaaatcggcgaacatgatgacgtctactattggcgtgaccgcatgatcaacccgccctacgaccagaagcagtaaaccatatcactatcgaccaaccgttaaaacaggtcgaatcatcgtgaactggtcgttatgacatatccacgattccataatttgcgactgtcaagtgagatcccgggcgcacctttgctccaccacacgggtaaggcgcgcctttttctgtgaaaactcagtcctagctgctccaatcaatcatgcttcccaccataatgcgcgaaacgtaacgcatacatgtccgcggtagatagttagataattatctaaataagaaaatgtttaaacattgcgaagtgaaggaggaatgtatggcaggggagggattcaaagcgctctccgatcccacgcgacggcgcattttggaattgctgcgcgaacgtgacatgacggctggtgaacttgcggaacaattcaacatgagcaaaccgtcgatcagccaccatctgaccacgttgaaaaccgcgggactggtaaccgacgaacggcacgggcagaacatcatctacagtctcaacaccacggtgatgcaggatctgatcggatggttcatgggattcatggacggcgatggaaacgtcaatcaagcgaatgatcaaacagacaataaataaaggagggtcttatgcgcgggaataacttgaacgatttcaaaaaggctttcgataacaacatcaacaataccaaagacaagaacaagactgattcgggggagaagatcgctccgatcggacgcaatctgtgcattgcgcttgttgcactgtgtgtagtcaacatcatcgcacaccttgcctgctatagtcggcttcccgaaaacgtgccgattcattggagcgccgatggttcggtcaatggttatggatcgcgtgccgtaacgttgattcttgatatattgccgttgctgtgcttggggcttttcctcgtcatcccgaagatggatcccaagggagaaaactacatgaaggccagcggactgtatcgtggattcgtcatcgcgttcacgctcattatgtgcggtgccacatggttcaccgaagccaccgcattcggtgtgatcccggctaccggtggtcctgttggacttatcatcagcgtggtgctgggagcgctgttcgtcggcttaggcaattaccttccgcgcatgcgccagaattacactttcggcatcagaacgccttgggctttggctgatgagaacaattggaagcgtacgcagcgtgtaggtggcatctctttcatggtattgggagtgttattggtcgtagcgggcgttgtcagctctgtcgtgcctgtgggcgacatgctcatggctgcaattattgtggcgatagcgatttgtgcggcgctcgttccctatgtgtacagctatctgctattccgccgcagccggaattcgcagtgatgttaaagcagctgggacgctgacgctccgacacaaccagtcgatatgcaacgttgacaaacaccgttggcaatctggaaaagtttaatgaacggactcaggagaaccaattgcaaacagtgaaggaatcgaatctgaatttcttcagtccaatggtcgagggcggttcacatgcgtgcgatccgccctctttgctaattcaagtgttcgttttgaaaaaagtcagaaatccatgcccaaagatttcagatcgcggcgagcctgatcggcgttagtaaagcggaacgcatgcatgcccacagcctgtgcgccagtgacgttcttcgcggtgtcgtcgaagaacacgctggattccggcctgagattgaaacggctcaatgccagttcgtagatgtcggcattcggcttgtgcatcttctccacaccagacaccaccgtgccctgcaacaactcctccagctgagggaaccgttcgaaagcaaaatggaacgtctcgtgcgaccaattcgtcaacccccacacgccgtagcctgcagccttcaaatcacgaagcagctgttccatatccggaatcatgcgggggagcgcatcgccatagcgttcgatgtaatcgcggaaaatttcagcgatctcctcaccctgctcgcgtaccacgtcgggataaatgtcttcgaaatcttcgccatggtccatacgatcctcataatcgtagaaaccgcacggatcattatctgcgcaaatacggtccacaactacttgggggtacctgccttcaaggcatgcgcgcgtctgccagtcgatgagcacgccgcaaaaatcaaagaccacgtcggtgacgttggcactgggggaggtcatgaaaatccttcctgcaaaatacggattggcaacgtcagtgtaacgcaaagtaaccgacgttggggctggtattcagtaaatttgttgcacaattaaagtaattgtaaaaatgcgggctgaatactgtcgataatatcgctggcgatgattggatggccgatttctccgaaatgctgctttttggaatgaccgtagatttgcggacgatgccatccgcgctgttcggattgcgatgcgatcgctcccgcaagaccatgcatgtaggcgccggcagccacgacctcgggaaccaatgccggatcctcagcaagcatgtcgtcctgctgcgcgagcagggctcccaacatgccggcgagcacgtcacccgatcctgcggtagacatccatgccggtgcgcgaccggaaagaatcacacgctcattgcgctcgccatcagtgcccaccaccatggtcaccgcgccctttagtagcacggtcgcaccggtcagctcacggagcttacgggcgcaggcaagcggctgtgaacacacctcgtcgacgctgacttcgttttcgcccagccgagtcagcatgcgggccagctctccggcgtgcggggtgacgaccacctgagccggcaccttatctggtagcaaatccaaggctccggcgtccaccacgattggtggcatatccagtgcgcctgcatgcctggcatcgacatcgtcgtcaaggtcggtttcttgcggcagcgcatagtgctttagcagcgcggctatggttttgcgctggaagtcggagtcggacgcttcgtcatcgcctgcgggaacgccggagccaaccacccacgattggacgcgtcccttgccgatcaccgcctcaggcaacgaggaaagcaccatatcctgcgtgcgttgtgggccaagataacgcaccatgcctgtgttggttcgtgcggcggcagcggaagacaacacggctgcacctgggtaacgtgcggaacctgtcactaagccgaccactccacgtgaatatttgccgtccgaaagctgcggcagacggatcgaatccattacgaaatcgccatccgtcatttcggtcgcgggaacgcaatcatcgatatcgaagccgaaatcgaccaaagtgaggtgtccgcatgcatacgaggcgggcggcaccatcgcgcacggcttcatcgcgccgaacgtcaccgtcacgtctgccggaatatacggtcccggcagcgaaccatcattcacgccaacgccggacggtgtgtcgatcgccacgacaagcggcagatcggaggagggttcattgttcggtaaggcgggcctgtcgggtagtttgctatcgaatcccaaggaggatgcgatagcgcctgcgacgccgcgcaacgcgccgcttacgccaatgccggtcattgcgtcgatgatcacatgggagccttgggcgtactctactgcggcctgcagccgttctccggccgctcctgcggagaagcccatggtacatccggggatttcggcggcggggtcgagtgcgagaatgcggcctccggcgtgcacgaacgcgctgaaagcctcctcgtgcagggagcggcccacggcgatcgcagtgacgtgcgcgccttcgttcgctaattccgcgccggcgtacaggccgtcgccgccattgtctcccgcgcccacaagcagggtcacgcgcgcatcttcgatggtgagatcctcgtcgtcgagcagcgtcatggtcacgtgggccgctgccgaggcggccatgcgcatcagcggcacaccgtcgtcaagcagcggacgttccatgtcgcgcacggtatcggagtcgtaggcactgtacagcagtgtttgcaaacggtcggcgtcgtcggcgatgttcataatgttcccttcctcgtcgtttatgggcaacaatccctactgtagtcgtaatattgggagttagggatttttcagcgtggaatggagaccaaaatggcatatatcgaaatgcggcacagttacaagcgttaccaaatgggttctaccaccatcaccgcgaacgatgatgtgagcttcagcattgaaaagggcgaactggccatcattctgggcgcgtcgggcgcgggcaagtcgacggtactcaacattctgggcggcatggacacgaattccgaaggcagcgtggtcatcgacggacgcgacatttccaactactctccgaaacagttgacggcctaccgtagaacggatatcggtttcgtgttccagttctacaatctagtggcgaatttgaccgcgaaggaaaacgtcgaactcgcctcgcagatcgtttccgacgcgcaggatgccgtcaaagtgttggaagacgtcggtctcggcgatcgtgtcgacaattttcccgcgcagctttccggcggtgaacagcagcgcgtggccatcgcccgagccgttgcgaagaatccgaagatcctgctgtgcgacgagccgacaggcgcgttggactacaacaccggcaagcaggtgctgcagattctgcaggacatgagccgtaagaaaggcgcaaccgtggtgatcgtgacccacaattcggcgatcgcgccgattgcggaccgtgtgatccgcatgcatgatggcaaggtcactgctgtcgatgtcaacgagcatccgatgggcatcgcggaactcgaatggtgatatcgcgacacgcggtgcgacactcgatttgcgaagacgcgtgaagcgtgtaatatatgtgacttgtgcacggaagcaattccgtacaggaagcacattcctgcgtagctcagttggcagagcatccgactgttaatcggacggtcactggttcaagcccagtcgcaggagcttagttttaggagttttctgtttttcagaaaagacttaaaacgggaaagatattcctgcgtagctcagttggcagagcatccgactgttaatcggacggtcactggttcaagcccagtcgcaggagccatatgaaagcccttggaaagcaagggcttttttgttattccagcgaatcaagcacgtcgtcgatcagcgtacgctcgtgcgatccatcggttttgagtcgagggaagcgtcgcaagacgttggcgggactcgcgccagccgcacgcgctacattcgatttcgattcgccatgagccaaagccgtttccgcaagacgatccaccagcgagtccgacaccttacgaatctgctcggcaacccacagctgcgccagctcgggggagagaacgtagtcgtcctgcaattcgcttgatgcttcctgtacggccgcccacagcaccataaaaggcttctgatagtaggtgatccgatcgtaatcggactcgccttccagctgctgcaacgctttgcgctgtgacgtgttatcgctcatgcgttccatcgtatgtcgcgacatgcccggagactgtggataactcatcctccgaccacagggccgtttcggctggacaatccaatcacatactgtcatgctggcaattcatcgccgcacagctcaacaaatcaacaaagcgacacagcaatgcagcaacgcgaaggagccatcatgaacgaacatgaatatcgtcgacgaatccaacggaacagaatcgtccaggaggaaaagaagctcatccgccagcagttgcgccaaatcatgatcgtatgcgcgctggcgtgcgtcatactgctcgtgtgctgtctatggtcggctgagccgacatatgcgaaaacgaattcgggcgacacgtccgaatcctgcgtaaccctgatgcgatggccgttgaacggcacgcaggtagttggcaagtatgacgcgccgaaacaacagtggcttccagggcatcggggcgtcgacttgctcgccgaccaacaggaagccgtcgtcgcgcctgcagacggcgtgatcgccttcagtggcagcgtgggaggcaaagccgtggtcaccatacggcatggaggcagcctttccggactgacctcgacgttcgaaccagccaagacggaacgtgatatcggcgcacatgttgtgcaaggggagcgtttcgcgcttgtggagggcgaatccgaccattgcgacgatcattgcctgcattggggaatcaaatcggaaggacgacaatataccgatccggaaagcaaaacccgtacggtgcgaatcggattgaaagtcctgtgaaacagaagggggcgacagaaccatcgattttgtccatacgtcgtggcctcgccgaaaaagtgaagctctcaggctatgatgatgcatgtacgacgattacgcaggggagaaatgccatgtataaggaatacacgcggcctttggagcagcagattgacacagacaaaaatattttctcggtgcttgaggaacgagtgaaccgtactccgaacgattctttggtggaatacaagaatgagcatggcgagtgggcgtcgttcagcgccaccgagttccgagacaaggtcatcgccatcgccaaaggcctgatcgcccagggcatcatgcctggcgactcggtatccatcatctctcacacatgctggcagtggactgcgcttgacgtggcgatcatgtcgattggcgcgctcaccgtccccgtatacgagacgaattcgcccgcgcaggttaaaatgatcttcaacgacgccaacgtcaaaatggcgttcgctgaagatgacgcgcaacgcgacaagatcgaatctatcagaagcgaatgctccaatcttggcgacgtctatgtcatcgggcttgacgcgattgacacgatggtcgaatacggtcatgccgtgtccgacgccgaattccaagagcgcgaacatgcggtcaaaggctcggacctcgccaccatcgtgtacacctccggttccaccggcacgccgaaaggcattgagctcacccactccaatttcgtgttcatcacctattccggcatcaactccatgcctgatatcgcgatgaagccgaaccgtcgtctgctgctgttccttccgttggcacatgtgttcgcccgctacatgcagttcttctgcttcgccggcaatgtttcgcttggtctgtccggcaacctgaagacgatcctggctgatttcaaggcgttcaagccgacgttcatccttgccgtgccgcgtatcttcgaaaagatttacaatgcggcgtcgcagaaggccggcgacggcctcaaaggacgtattttcgcaggtgccacacagacggcgcgcgactggtcgcacgcacagcagtcaggcgaaggtattccggttgtcttgaatctcaagcgtgcgttgtacaacaagctggtgtactcctcgatcatggacgtgttcggcggtcatgtggaatatgcggtttccggaggcgctccgcttgattcatccatcgcgcatttcttcaatggcatcggactaccgctgctggaaggctacggcatgactgaaacctgcgctccgtcaagcgtcaatccgacctctggatacaagattggcaccatcggactgccgctgcagggcgtgaccatgggcgtcgacgaggaaggcgagctgtgcatcaagagcccggccgtatgcgccggctaccacaacaatcccgacgtcaccaagcagcagatcgtcaacgggtggctgcataccggtgatcttggttccatcgacgacgaaggcttcgtctccatcgtcggacgtaagaaggacctcatcatcaccgccggcggcaagaacgtctccccgtgcgaaatggaagcatcgatcatgacgtcgcccgtggtgagccaatgcgtgatgatcggcgaccgtaagccgttcatagcggccatcatttcgttggatcttggcgaaacgaacgcatggcttgcgtcgaagggcgcggaatgcgtggcatccctcgaggaggcctcccgcaatccgatcgtgcgcgccgaagtggaacgtgccgtcaacaaagccaacgagctcgcatcccgtgccgaatcaatccgtaaattcgaaatcgtgccggacgagttcaccgaagaaaacggcttggtcacgccgagcctgaaggcacgccgtcaggcggtggttgaccattaccgcacgctgattgacaccgtcatctacgttccgaagaacaagtaaaatgcgatgatcgtcggtaggaacgcgccggcttcaacataaaaaagctggcttccgtcgcagcggttcgacggaagccagctttttctatctcttgtcggacttcctatgcctgataatccggattaccttgttgccggtttacaagcctgcttcggcgagcgagatatatcccggttcgatcagcgttttcttcagattgctggcactgaccgcaagcgcctcttcttggatggtcggcactttctcgtcttccatggcgacggatgagatgaacgtcagcttcgcaagcttgcccgacgtgttaagctgcacgcaggtctgtgcgatgtcggatgccaaggtcttgcgattttccaaagcggtcatccactgtttgccgttcacgatattcggtatggagctgacgtaggcgccgtaaccggtgatgatcggccattgcgagttctgctcgtcaagggaatcgctggtatcctccgtatcggaatcgccgtcatcggattcaggcgcctgcgcaggatcgggaacggactgttttttcaagtctttcttgccggtgatattgtctacgatgccggaaatggtgatggatgggttgatgtcggccgccgaaccggtgtatccaagatcattgagctcttcggaaacataaccggccacataatcattgcaggagatgataccgtcgatgcgggtatgacgcgatgtgtccttgtccatgccaagacgttcggcgagcgtggatttgacccgctcgcttttcgccgcatcgaacgccacagacgcccaatcggattccgtactcgacgaggtcagcgtgccggacggggaaacggcctttccgtctttgaaatacggtccaagcaccgaccaaatacctttgaacacgtcttgcgcgaaagtcgcgtctaccgtattaccgctttcatcggcggcatcgtaggggagtagcacttcgatatgcttcggattgtcggagctggttttgtcgagttcaagcttgctgaccagctgcttggcctgcagttggccgacttgctcggccgtggtcatcggtgcgtacacatccggagtgaaaccctgcagcgtgttcgacactaacacgactttcatgccctcgttttgagcgagctgcaatgcggaaaccaagcgttttgcggattgggcgtaatcctgggcgtcttcgtcggaggagttcccatcccatgtgatgtcgtgcgacgcgtagtctccatactggcggtcggattcggtggtgtcggccaccggcgccactaccagagtggttttgtcggaggaacccgcatcgtcgctggtgctgttgacgtggttcaccacataatcctgtacgctttggctttgcttgtcgaggctcgacgccgttttgacggtgatgttagagcccttgacggcgttatcttttaaagatgagactatttccggcactaatttttcccatttgctcaaaggcgtctgctgggagatggtaatgccatccgaaggggtgaagatcaccacgttgccggcatcgacggtagtggtggtgccggtggagtccgcttcatgcgattgcgtttcattgtcggatgagcaggcgcccatggccatgatgagcgaggtcgatgccaacagtgcgaacagacgtttcgtcacagtcgtgcggtgcagtgtcatgccgtttccttcatgaaaatcgaatgatgattcctatgctgagctctgattgtaatatctggacgtcaaaaaggactggatatgcgtgtgaaccatacatatccagcccttgatcctgctgtcggccgttcagccgaaggttattcggctgaggatcattcggccagagccttggcgagattctcgtccaaagcgttcatgaagccttcggtgtcaagccaggcctgatccggaccaacgagcatggcgagatccttggtcatctggccgccttcaacggtagacacgatgaccttctccaatgtttcggcgaaatacttgacttctggagtgttgtccaagtcggcgcggtgcttgagaccgccggtccaagcgaaaatcgatgcgatcggattggtggaggtcttctcgcccttctgccagcgacggtagtggcgggtcacggtgccgtgtgcggcctcagcctcgacggtctggccgtcaggggtcatgagcacggaggtcatgaggccgagagagccgaagccttgcgccacggaatcggactgcacgtcgccatcatagttcttgcaggcccaaatgtagccgccatgccacttgagggagctggccaccatgtcgtcgatcagacgatgctcataggtcaggcccgctgcggcgtacttgtctttgtattcgttttcgaacacttcggcgaacgtatccttgaactggccgtcataggccttgagaatcgtgttcttggtggaaagatataccggataacctcgcatcagaccatagttaaagcaggcgcgggcgaaaccacggatggaatcgttcacgttgtactgcacctgggccacgccgccgtcggcgccatagttgtacacgacatgctcgatcggctcggaaccatcttccggagtgaaggtgacggtgagcgtgcctgcccccggaaccttgaaatcagtggccttatactggtcgccgaacgcatggcgggctactacgatcggcttggtccagccgggaaccaggcgcggaacattgctcatcacgatcggctcgcggaagatggttccgccgagaatattgcggatggtgccattgggggacttccacatcttctttaggccgaattccttgacacgcgcctcgtccggtgtgatggtggcgcacttcacgccgacatgttcacgctggatggccttcgccgcgtcgacggtcacctgatcatcggtggcatcgcggttttcgatgccgagatcgtaatattcgagatccacgtcgaggtatggaaggatcaggcgattcttgatgtctttccagatgacgcgggtcatttcgtcgccgtcgagttcgacgaccttgccttcgaccttgattttggccatatgttgccctcctgtcgggattgaaggtgataagttcctgtcttataacaaacgtgttaacgacacctgttaatgtccaaaaaaacggtgtggcggcaggtgacacgctcttgcatactgtcattgctgagcattagccttgaaaacatgtctcaggaaattgaaatcggtttgggcaagaagggccgtctggcatactctctggacgacgtttccatcgttccctcccgtcgtactcgcgatccgcaggatgtgtctacctcttggcaggttgacgcctatgaattcgacgtgccggtcatcggcgcgccgatggattcggtgaccagcccggccaccgccatcgccatgggcaagatgggggcgctcggtgtgctcgacctcgaaggcttgtggacccgctacgacgatccgcagccgctgctcgacgaaatcgccgagctgccggctgaacgcgcgaccgagcgcattcagcagatctacgccgagccgatcaagccggagctcattgtcgagcgtctgcatgagattcgcgacgccggcgtcaccgttgcgggcgcactgtccccgcaacgcacgcaggactattattcgaccgtgctcgaagcgggcgtcgacctgttcgtcatccgtggcacggttgtttccgccgagcatgtctcccaggatcacgagccgttgaacctgaagaagttcatctacgatttggatgtgcccgtcatcgtcggtggcgccgccaactataccgcggctctgcatctgatgcgtaccggcgcggccggcgtgcttgtcggcttcggtggcggcgcggtatccgcgaaccgcaacaccatcggtgtccacgctccgatggccaccgccatcgcagatgtggcggaagcacgccgtgactacatggacgaatccggcggccgttacgtccaagtgatcgccgatggcggcatgggcgactccggcagcttcatcaaggcgttcgcgcttggtgccgatgccgtgatgcttggctccccgctggctcgtgccaaggaagctccgggcaagggcatgcattggggtgccgaggcccgtcatcagacgcttccgcgcggtttccgcacgaatgtcggcaccgtcggcactctggaagatatcatgttcggccccagccacaatgcggacggcaccaccaattacattggcgcgctccgtcgtgccatggcgaccaccggctatgtcgatctcaagagcttccagcgttgcccagtcacggtcgctccgacccgctgaacgggcttcgcggtaaagcctgaataacggttcattgatcctgcagcgtcatgctgcaggatcttttttattatgtttccccggctaagaaagtcaggttggaatgattaagttatacatcgcaaatgaggtagcggaggtgagatgaatggcagcgcgtagaagtggcgatccccgacgtttggacccgttgtccggacgattcacggattacatcgtgatcgatacggaaacaaccggattgagcgtgcgcaaaggcgccaggctcattgagatcggcgcggtcaaaattcacaacgatgagctggtcgacgaattcgaccagctcatcaacccgttcgaacacgtcccgtcaagaatcactggtttgacgggaattgacgatggcatgttgctcggcaaaccggatgtgcgtgaagtcatggatgagttcgcgcgctggtgttcggacacggccgtggtcatggcgcacaatgcatccttcgacatgtcgttcctcgacaatgctgtacagctcgcttacgcggatcgggatgcgcgcttcgcacaccatttcgtcgacacattggacctcagccgtcggctgcatccggaaaaacgaagccacaaggtttccaccctcatcgtcgactaccacatcgccgacatggaggagcaccgcgcattgtctgacgccaagcaggagtggatgctgtatcgcgccatgcgtgacgaggccgagctgctcggcatgctctgacagcctaacgtcgttcgaacacttcgatccggtattctcccacaggtgtctgttgatttgtggatggattatttgttcggcttcgtgccgcagcaggcatcatctctgctggcggagagcactgcattgggagcgaagttcagagtgaaaccactctgttgttgggagacgttggctgaatcgaatttggcgtcattcgtgatatttgtcctctgcgagggccctgtcccggttagggcctgcgtggaggtttgcctgaattgttcgccgtcgttgaggtcgtcggaatattctttgcgcccatagtagaggtcggtatccagctgatgctcggtctgcgcgacgattactgcggtaattgcattggaccagatggaacccaccgcaccgacataatcggtatggcctttgaaagcaattcccaaaatgatgccgaataccgttgcaagcagcacgcgtgtagtaaaccctgcatttttcttacgtttgaggaacgataggacggcgaacaggatcgcggctacgccgagcacgatccaatcatatgagatatttgacattattgttattcccctcccaaaaatgatgatgcgttacgtgggatacccccacgttcatgtcggacatcaatctatccgctcgttcttcgacgcaacgccttgtggctattgccgttttctatagtcgtttatcagacgacagtcattacaaggcgtacaggctgacgttccagtgttccgcaagtcgctccaagacgtagttgttttgcgtttagggagggctcgttttaatatggggcgtcggataactggcttcgtgtctgaatttgttaggtcctgaggaattggagattagacatggcattaagcgccgcgattattcttgcggcgggtgagggtacccgcatgcgttccaacaaaccgaaagtgctgcacactttggctggaaagacgtttttgaaccgtgtgatggattccgtggcagcgctcgaccctgaaacgttggccgtggtcgtgcactaccaggcggaacgagtcgccgaagcggcccgctcctacaatgagcgtgtcaccattgtcgaccaggatgacattcccggcaccggacgagccgtgcagtgcgccatgacgcagttgaaggagcaaggcgggcttgacggctcggtgctgatcgcagcttcagatatgccgctgctcgacgccgacacgttgaaccagctgcttgccttccatgagcaaagcggcaatggtgccaccgtgctcaccaccattcttgacgatcctaccggctatggccgcatcattcgcgacagtgaaggcaacgtgctgcgcattgtagaacagaaggacgccaacagcagcgaactagccgtgcacgaagtgaatacgtccgtctacgtgttcgacgccaaactgctggatgaagcgatcgccaacctcaaatctaacaatgctcagggcgaattctacctgaccgacgcgctcgaaaccgccaaagccaacggtgccgttggtgcgttcgccgcccccgacccgttgagcgtcgaaggcgtcaacgaccgcgtgcagcttgcggcgcttgccaaagcccacaacaagcgcgtctgcgagcgttggatgcgtgaaggtgtgaccattctcgaccctgaaaccacgtggatcgaagatgacgtgcgcatcgaacgtgatgccgtgatccttccaggatgcttcctcgaaggcaacacggtgattggcgagggtgcgcaggtcggtccatacacgacgcttatcagcgcggtcatcgatgccgacgcccgtgtggagcgttcccgcgtgcaggaaagccacattggccgcgccgccaacatcggcccgtggacgtacttgcgcccgggcaacgatcttggtgaagaatccaaggccggtgccttcgtggaaatgaagaaggcacacatcggcaacggcaccaaggtgccgcatctgagttatgtgggcgacgccgacttgggcgagcataccaacatcggcggcggtaccatcaccgccaactatgatggcgtgcacaagcaccacaccaccatcggatcgaacgtgcacgtcggtgccggcaacctgttcgtggctcctgtcgaagtcggcagcggcgtcactaccggcgctggttccgtggttcgccacgacgttccggacgattccatggtctattccgaaaacacacaacatgtagtagagggctggaagcccgaatgggagcgctgaatatgccggcagtacaagattccatcgacgccatccgcatcgccgcagccgcggctgaccgtatgaaggccactgacctcgtagccttcgacgtcaccgaaccattggccatcaccgacgcgatgctcatcgccaccgcttcgaacgaacgtcaggtgctgtccgtcgcagaagaaatcgaaaaggacctgtatctcaaaagcggaaagcgccagccgcgttcccgcgaaggcctgaccgaaggccagtgggtgctgcttgattacggtgatttcgtgattcacgtcatgcatcaggaatcccgcgacttctaccgtcttgaacgcctgtggaaggattgcccaagcatcgacctgcagctcgaacatcctgaaacctccgacgaagagaccacggaaaccgcggaataacacgtacgaacatgccttcacgtttgaatgcggaaggcatgttttcatatcaagcgaaacagtattcgcaaattccatcatcgagaaagcaacggagaatagcagcatgcctcgaaacgtcgaacttgagcataacagcgcagtaccggaacatgtgcacgccatcacactggtgcgtcacgggcgcaccgcctacaatgcgcaacatcgtctgcaaggccagatcgacattcccctcgacgaagtcggccagtggcaggttcgccaaacagcggtcgcattgcgtgaactgtatgttgaccgtcgccccgatattccgaaccggctggtcgtgtgctctgatctagggcgtgcctctgccacggcgcatgcatttgccgatccgctcgggctggaggtgcatccggacgcccgcgtgcgcgaacgtagcttcggagactgggagggcattcccgtcgaggagcttgcgcaacggtatccggaagactatcgttcctgggccgagttccgcggcggtgaacttaaatacggtgcggaacccaaggaagaggtgggacgtcgtggcgttgaggcattgaacgattgggcgttccgtgccggatccgacacggatctgtacgtgttctcgcatggtgcatggatttcccaaacgttgcagacgcttctgggcatggtggatgtgcatggcgatttcgccgacattttgtcgatgcgcaacgctcactgggtgcggctcattccattggagatcggttccacattgcgttggcgtttgatggattacaaccatggtcccgccattgccgattccgaggaatgggagcatcccaatctgtagccagtctgtgagtgtcgtcacgtgatggctggtcactgtttttcaagcttttcacagaatcgccagtactttcatagcgaaattagctatcgtcatggcttgtgaaaaacttttttaagggaatctctttttcgtcgatttgcgcgggcgcgctggcggcggtcacgtcattcctgctttctgcgaaaatcggtatcgcgggatcggtgattggcgtggctgcgggctcggttgtttccgcagttgccacgcaggtgtacaagaacgttttaaaggtgtcgggggagaagatccaacaggccgtgccgttaccgtcaagtagtgatgctgctgcggatgaaacgcaagtgcttggctcttccacgaagggtgacgagacgaggattatcggatcgtctcctgttgcgttggatgccacgatggtatcgtctgatgatgtgactgcggtagcaccgtccatctcgccgcgcgtcatttcctccgagcaggaggatgaggatgctacccgcgtgcttggtgatattgccggagcgggggagacctccgtgtttccgaacgggcatcgtggcgtcggtagcgctagcatcgccagcggaaaatccactgctcgtagcgcgcgtgatgtccaagtgcagcatgcggggcaacgttcctcgaattggttgcataacaaatatgttccggcgatcatcgcattcgtcagcgctctggttggtgtgggagtgagcgcgggattgattctcgctttcaccggcggtcagggaacggataccgtggtgcgtaacgtagtgcatgagaaggtcgtgccttcgtatgaaaacactggcgattccggatccggtaatgagcagactcctgtgcagaagcccaagtccgattccacggattcgaatgatgaaaccaccacggacggcagcgacaagaccaccagcggttccaccgactcgtccacttccaatggcacgtcaagcaatacccccaatggttccacgtccggaaacaccggatcgtcatctgataattccagcaacggtcccagccagaccggaacggactcgtccaacggtaccggctcgaacggaagcacgtccggcaccactggtgatggttcatcatcgggaactggaagtagcggcactgacggatcgacaagtactggcacatcgggatccaccgacggtactgccggttcgacaggaggtgcaagcagtaactaacgttactggtgtcgcaccttccatgtcgcccgcctagtatgattgcgtatggcagattacatatggcgatttcccaatgcgggcgacacgccggaagttgcatggttcatgtctgtgatgtatcttatacgaggtttgcagagcagacttcggggctatggcgcagctggtagcgcatctccatggcatggagagggtcaggggttcgaatccccttagctccacagatagggtttccgatgattttcggaaaccttttttcatactcaaaccggcggaattccaacgatttcaagccctacggcagcgatgccaaaagtctacagaaatccaaaaaaccaacaaaatgtatacctgaacgtgtctcataaaaacataggggtatggtccaaataaatcgcacctccgatcatcgaatctgtatttcttcagtccaacaatcggggtgcggttcacagcaaagtgcggaacaggtgctatctctcctgaattcggtttcagatggaactcgtatgtgatgttattcacgttgggcgaacatgcgttgtggggtttcttgccgtaatctgaaagcatgtccgcattccatgggcatgcaaacgaaaggacggcatcatggcagatctcaccgatgagatgaaggaattcctcaacagcaacctcgcatgggtggccactatcagcaaagaaggccagattgatctcggaccgaaaatgagcacgttcatcatcgacagcagccatatcggctaccacgagcgcaccgctggccaaacataccgtaacctgcttgacggcagcgatctggtcgtcgcagtcgccaatcttgaacagaagaaaggctaccgtttccgcggcaacgtcgtactccattccgacgatgcgatctatgacgagcaggtcaaggtcgccgaggaacgcggcacgaaaaagccggtgaccattccggttttggagatcacggaaattcaggatctcaccccgggcgctacggcaggcaaaaccatcgtcaaggactgatcagttccatactgaaccagtcgaaacgacaatatcggagaaccgcagacgggactgtatgtccggtctgcggttcgctgttatcggaacggaagatcgcgaatctacagcatatcgttcgcagcggttcgaccatggattcctatacggcagctgcatgcatgggctgtggataagtgtggataagtgttcgctcatccacttatccacagattttcttacggaggtggcgggcgaatattggtttctgccatgctggtctgcacgcataagcgaagacgcctatgcgacaaccaacaaccaaagaaggtgaaccatgacacaacgcaccatacgccgccgatgcgcagcattcctcgccattggcgcgatggcggccctcgccatgccgagcacggcccaagctgctccacaattggccgatctggaagccaaacagtccatgagcgtgaaagcaagcaacggggaaagacttgaaggcaaggacctccacgccatccaactcgccacatacactgcggcaagcgtggacgacaacacgattgtcggctacgatctgaccacgaacacagcattggcgtcagacatcaccgcggcggccaaaacagccggagccaccgacgcgaacctcaccgtcaacggcaaaaacgatccgatggtgtgggtggtgaagaatctgaccgactcacgcagtgatccgtggagcggaaagctacgcaacttctgtaatagccttgccaaacaaaccaacttcgccaaacaggagggaacggcggtcgccacgctcagccaagacaaaaccaccatgtcgaccggcaacgtgctcgtgccgggaatctacgccatcgtggaccgtacgccggcaacaaccacgccaagcggcggaaccgccgtcaaaacaaccgcgtccatcatgatgatgaacggcaccgcggtcaacggcatcagccaactgcgcacggccagtggcacgaccttgacgctcggacaggtgatctacaaggtatccagcgtggaaacacccgataaaaaagtcaacgtcggcagcacgtggaaagacagcgcatccgaagcgataggcaagaatctgacctaccgcgtgacgcagaaaattcccaactggacaggctacgaccactactatcttgcgttgaacgacacgctcggcacaggcctcgactatggttcgctcacttcaatcaccgtcggcggcaaagcattagcaagcacgttctacaaggaaaacgtcaacggcaaaaccatcagctggctgttcggcatcaacggagacatcctcgcctcggacgcatcaaaggcagccctaccggtcggcgcgacgatcaccgtcacctacacggctcgcctcaacggcaacgcggtcatcggaagcccctgcaacgtcaactccatcgacctggaatactcccacaaccccaacgcatggcaggaccacaacaaccagcccggcaacgaagtcaaagtctgcactggcgaaatcgcattgcgcaaggtcgacaccaaaaaccaaaagctcaccggcgcgaaattcaccatcgcccaaggtaccagcgacaaaacacctttgaaactcgtgtcactcggcaacggcaactaccgcctcgccaccagcggcgacaccaccaccaccaccacgttcgaagccggagaaaccaaaatccaaggactcaaaggcgaatacaccatcaccgaaacacaagcgccccaagactactcgtcgctcatgctgcccagcgcggtcgtcaccgtcaacattgacgacgccaccatgacgtggagcatcgacgtcaaatccgatcccaacaacctcatcaaaaaagatgatagtcacaccgtggtcgtcaccaacatccgcaccatcaccgaaataccgttgaccggcgcggcaggattgaccatgcttttcagcatcgcagcgctcctcttcataggaggcatcgtaatgctgcgcatgtgcaaatcagccgacgaccgctaaccggcatccaacgataggaaacacatgacggttcccacacacggcaaaccccgacacaaaagcacgtcggcaaaacacaacatcatccgatggtgcgtgggaaccgccatgctcaccgcaacggcactcatcatcagcatccccctgatcatgcgcgctgaagacaacatccaacaagcagccaacgtcaaagcgtacgcagccaccatcgccaccaccgcagacacggcaatacaagaaagcaaacggcaggcgaaactctacaacgcacgcctcgccaaccgaaccgaaccccaaacagatgatccggcagacagctcaactgacagccagacaaaacatgaaaccccaacacaaaaccccatcgaatacaatcaacaactcgtcatcccacccagcgacgtcatggcaaccatcaactacccaaaactcggaatcaacctacccatacgccacggaacaagcgaacaagcgctcgccatcggcgccggacactgggtgggaacatccctgccgatcgggggagcaggaacccacaccgtcatcaccgcacaccgaggcctcgccgacaaactcatgttcaccaaactcgaccaagcccgcgaaggcgatgaattcaccatcaccaccctcggtgaaaccctcacctaccaagtgcaaaccatccgcaccatcacccccgacgatttcacttggataaacaagcgcgacaacaccgccgatcaggccacgctcatgacctgcaccccatacggcatcaacacacaccgactcctcgtcacaggaacacgcatcccaaaccacgacgaatgcccgcccgaaacaggctgcctcaccgacggaacactcgccatcacagcgttcgcgctcaccaccgtatgggcaatcatcatcgcgctcgcacgccacagttacaatgagatgcatgatcgacgaagtattgttcctacgtcacggacgcaccgcctacaacctcgcaagacggctacaaggccaaatcgacattcccctcgacatcgtcggcaggtggcaggccgaccaaagcgcttatgaactcgccagaacatactattgggcgaaagtcgcgcacctcgccgaccataatgacgaactcgcccaacccgcgtacgagggcgcgtatttcgccgatctcaacgaaatcaacgaggcaccggccgcaagccgacgcatgttcgtcgtgtcgtcagaccttttccgcgcccaacagaccgcccacgccatcgccgaccttctcggacttgacgtagctctcgacccgcgtctgcgcgaacgcagcttcggcgaatgggagggcatgacccgtgaggagattctcgaacagtacgccgaagactaccattcatggcgcacccacactggaggcgaaaccaagcatggcgtcgaaagccgtcagcataccggccagcgtggtgcccaagccatccgaagcatcatcgccgagcatgccggcgattccgcgccaaccacgctgctcgccgtcggccacggatcatggatcgtggccactgtcgccgtattgctcgacatggatccggatgatctcaacaatctcggcgccatgcgcaacgccttctggacgcggatgagcgtcaatgcaagccgtggccccgccgaacctgacacatggcagtggaagctcgacgccttcaaccaaggcccgtccatcgccgcgcttacggactgggagaacggtccgaaggaattgcacggcccgaacatgccgttgtggaagcccatcatgcagtgatatgcagtggcatgcggtagctcacggtggccgttgctcaccgtgggcgcatgcggtgaacatgaattctcgatgaaatctccggctcgcggtcggttagctcccaaggttggactattctaaataaggttgtttgcccgaatgatccaagaacggtcccaaaagactgattgcaggagacgttggattcgggctaccgtacagcgatagaacgttggaaagcgcgaaaggcgggtgagagacatgttgagaatgttcagaacgattaacggccaggtggagcagatccaaaaaccagaaaacgggtcctggttatgcctttcggatccgaccgatgtggagctcgccaacgtttccatggaaaccggcgtcgatctcgccgacttgcgcgccccgcttgatgacgaggaacggtcccgtgtggacgtggaagacgattacacgatgatcatcgttgacattccaaccgtcgaggagcgtggcgggcgagactggtacgagaccatcccgttgtcgatcatcatcacgcagtcggccatcatcaccgtctgtatgcaggacactccagtgctgcacccgttcatggaaggcacgatccgcggtttcaacacgtatatgaaaacacgtttcatcctgcagatcctgtaccgcaacgccaccatgtatctgcggtatcttcgcatcatcgaccgtgaaagcgacaagctcgaactcaaactgcgtcattccatgcagaatcgtgagatcctcatgctgctcgaattgagcaagacgttggtctatttcaccacgtcgctcaagtcgaacgaaatcgtgatggaaaagctgaccacgctgccgcgcatcaagcagtatccagaagacgaagatctgctcgacgacgtcatcaccgaaaacaagcaggctatcgagatggccaacatctacagcggcgttctagccaacatgaccgacgcgttcgcgtcgatcgtgtcgaacaatctgaacaacgtgatgcgcatcttcacgatcatctccatcacgctgtcgattccgacattgatcttctcgatgtacggcatgaacttccaggagggcatgctcggcatgccgttgacagacaagccgtggggcttcgccgtgatcatcggaatctcgctggtcgtttcggccattgtcacctggttcctgacacgttcacgcatgttcaagtagaatcgcgtagaatcgcgcgtatgtcacgtctgtcacgaaatatcgcggcgctggtatgcgccgcttcggtcgtattgggcacgagcgcgtgcggtacttccatttccgtcgtcaccaatggtcttgctcaagggccgaccattgcgattggcgtggccgcggaccagccgggattgggttttctgcatgggggagagtattcgggcttcgatatttccgtgtcgcaatacgtggcgaacacgttgggattcgcgcaaaaacagatcgtgttcaaacaggtgttgccgtcgacgcgcgtttcgtcgcttgaagacggcactgtggacatggtggtcgatgctttcgcagctgatgacgttcaggatggtgaggttgagtttgcaggaccgtatctgaccgtgcatgcggcattgctggtgcgttccgacagtgcgggaaccatcaccggaatcgacgatcttgccggaaaaacggtatgcgtggccaaagacggaatgcccgccgatagcgtgcgaaatcttgcggaagatgtgaccgtgagcgaacgcgacacgtatccgcagtgcgaaacggcattgatgatcgggcaggcggacgccattgcggccgacgacgccatagcggcgggcctcgcatccaacagaggaggtgggtaccttaaggtcgtgggcgaaacgttcggcgaacgctcgtatgcgatcgcggtcaaacccggccaatccacgcttgccaaacaggtcgacgccgcattgcagtccatgatggacgacggctcgtggaagcaggccatggacgagatgaaacagtcgattggctacgttcctgacatgtcgatcaaccctcccgcgataacgcgctcagcggcgtcggaaggctgacgggcttcgccttgcgcgacgctttgcgaaacgcttcttgcataatgattgacgccttgcgaagtgtccagttgcgcggctagtttcatgcattatgagtgacattgagaaaagcgcgcaggcgcagtcgaacgaaccagccgagccgtcgttccgttacaatgcggatctggctcagggcattgaggaaaaatggcagaagatttgggatgacgaaggcactttctgggctgccaacgtcaacggcgatctgaaggacggcaagggacgcaacgccgaaggacgcccgtcgtatttcgcgatggacatgttcccatatccgtcgggcaagggtctgcatgtgggtcacccgttgggctaccttgccaccgatgtggtcagccgctaccatcgtatgaagggcgagaacgtgctgcacgccatgggctatgacgccttcggcctgccggccgagcagtatgcggtccagactggccagcatccgcgcatcactaccgagcagaacatcgccaacatgcgtcgccagctgcaccgcatgggcctgagcttcgacaaccgtcgttccttcgccaccatcgatccgggctacgtgcgttggacccagtggatcttctcccgaatctatgattcctggtacgacgaggatgccaccaatccgtctggttccaagggctgcgcacgaccgatcagcacgctggtggagcagttcgaatccggtgagcgtgagattccgggattcgcgggcaagcagtggggagacctgagcgaagccgagcaggctgacgtgctcaacgacttccgtttggcctatatctccaagtccccggtgaactggtgtccgggcttgggcacggtgctcgccaacgaggaggtcaccgccgaaggcaagtccgaacgcggtaacttcccggtgttccagcgcgagctgcgccaatggtccatgcgcatcaccgcatacggccaccgtctgatcgaagatcttgatggcatcgactggccggagaaggtcaagctcatgcagcgaaattggatcggcgaatcccacggcgcttccgtgcatttcgaggtcgaaaccccgaacggcgtcaaagacatggagatctacaccacccgtcccgacaccctgttcggcaccacgttcgccgtggtctctccggaacatcacctgctcgaagacgttcccgccgaatggccggccgagactccggaagactggaagggcggctatgccactccggtcgaggcggtgaaggcctaccgcttggctgcggaagccaagaccgccaaggaccgtgttgacgaggctggcgagaagaccggcctgttcaccggcctgtacgccatcaacccaatcaccggagccaagctgccgctgttcaccgcggattacgtgctcatggactacggcaccggtgccatcatggccgtgccgggcggcgaccagcgtgattacgatttcgcggtcaagttcggcctgccgatcatctacaccgtgcagccgctggccgaatccggcgacgatctggccaactatgaaggcaaggcaccgttcatctcccacgacggcatcgtcatcaactcctccgtggacgccacccgcgccaagggcgacgcgttgagcctcaacggccttcgcgtggacgaggccatcgacaaggtgaacgcatggctggaaaaggccggtgtcggcaagggcacggtcagctaccgtctgcgcgactggctgttcagccgccagcgttattggggcgaaccgttcccaatcgtctatggtgcggacggtactccgcacctgctgccggacgaccagttgccgatcaacctgccggatgtgccggactatagtccgaagaccttcgatccggaagacgccgaatccaatcctgaagctccgctgagccgcaacgaggattgggtgaaggtcgaactcgacttgggcgacggcaagaagacctactatcgcgacaccaacaccatgccaaactgggccggctcctgctggtactacatgcgctacctcgacccgaccgacaccgaacacatggtcgagaagagcgagttcgactattggatgggcccgaaccacaatgagaccaccggcaagtccggcggcgtggatctgtacatcggtggtgtggaacatgccgtgttgcacttgctgtactcccgtttctggcataaggtgctgttcgacctcggtttcgtcgattctgcggagccattccacaagctgttcaaccagggcatgatccaggcgtatgcctacaccgatgaccgtggccagtacgtgccggccgccgaagtggtggaaggcccggccgatgcaaacggcgagccgactttcacttggaacggcgaacacgccaaccgtgagttcggcaagatgggcaagagcctgaagaacatcatcacgccggacgacatgtactcgaactacggtgccgacaccttccgcctgtacgagatgggtatgggaccgctggccgaatcccgcccgtggaacacgcgcaacgtggtcggatccatgcgtttcctgcagcgcctgtggcgtaacgtcgtcgatgagaacaccggcgaagtgcacgtcaccgatggcgaactcgacacgaagacactgaagctgctgaacaacacgatcgccgacgtgaccgtggaaatggaagcgatgcgtccgaacacggccatcgccaagctcatcgtgctcaacaaccacttgaccagcctcaacgaggtgccgcgcgcagccgtcgaaccgctgattctgatgctttccccgatcgccccgcacatctgcgaggaactgtggaacaagctcggacacagcgagtcgctggcgcacgccgaatggccgaaggccgacgaacgctatgtcggacaggacaccgtcaccgcggtcgtgcagatcaagggcaaggttcgtgccaagcttgaagtttcgcccgacatcgacccgaaggaacttgagaagatggcgttggaagccgtcgccgaccgtttgggcggcaaggaaccgcgcaaggtcatcgtcaaggctccgaagatcgtgtccatcgttcccgcggaatgatatttcgaaaaaccttcggaaccaacggccgctgacaaggtttccaacagggtgtgaaccgttcccgcatgaggcgacacgccgaatatgtggataacccgcatcctccgaccacaggggccgtttcgactggacagcatgcccatgcatcctccaatttggatgcatgggcattattattaccccgccaaacaggcggaacaggcaggccgagatcacatcgccggccacgcggcggctgcgtggacttggcatgcccaaaacgcatgaaaggaacatgcgcaggcaaaacattcgcagcgaacatgtccctcccgcaacccctgaagcatctgtggcaatcgcggcaactgcaacgcctgaaatatcccgtgaacaaacgtcggaacctgcgaaaccctcattgcgggatctggccggagtcaaacctgccgacacgccgacggaacaggacgggcccaaacgcgatcgtccacgactcgtctttcagccaatccacgcggtcatcgccatactcaccctgtcgtgcgcgctgtgtgcaagtctgaccatgcttgtgcaacaggccatccactacagcgcactccaacagacgcagatcacgcaatccaaacaatctcaggcgagcggaaccacgaaagacggggcgtcatccgcggcaacaacaccaaaccagcagccttccatggaacaaaacggccagaacaagcaaacatccgaaccaacggaaccttccgatccggctgacggtctgttgaatatcaacaccgccggatccaacgaactgcaaaccttgaaaggcgtaggcccggtgaccgcgcagcgcatcatcgactaccgcaatcagatcggacgtttcgacaatgtcgaccaattgttggaagtcaacggcatcggcgagaaaacgctggcgaaattccgagaccaagtgtgcgcacgatgagaggaaacacgttcgaatggcggaatagggagcaggggagcagggattggcgtctactgccagccaccctgtgcgggtgggcggcgagtctggccgcacatgcggggttcgactactgcgtcgagcaggaaggcagactcggcattctgccgctcgttttagtgttgtctgtgccattgctggcattattgggattgttgggattgccgtttatgcgatcgcctatcctgcgcctgccggttggcgtgcggcgggcggttgcggcacggcatttcagcattatcgtatgcgtggtcgcggcgatggcatgcgcgtcttccgcattgacctacgacgtattgcaatggagggatgcggcctcgtacgcggccagaagcggcgaaagcgacgttgtgatactggtacgtacgacatcccccgcagtgaattcgaacaggcgtgcgaatgattgccagatcgatgcgacgatttcgacgatcacggcaagccagatcacgcaaccaagcatgatgcgggtgcgcgtctatgcggaccggccggactgcggcacactcaaacaaggcggcgaataccggatgcggggcactctcgccatatcgcaatacggtaccatgccgctatggctgacggacatcgcctctgtggaacgcatacgggcacccaatcccgcattgcgtgtgatcgatatgatgcagcaggcgttcttcgaacagacgtcacggctttccgaccaaggaaaagtacttgttcccggactgacattaggcattctcggacaggattacattcctccagacagcggcaatggcaaaactggcaccggtattgattccacatacgccaatctgcttgaagacgccttccaacgttcgggcatactgcatctgatggcagtcagcggcgggcatctcgcggtcgtcgccaccatagtgcgcgccgcctgctcgttcctgctactgccaaggcgcgtcacggccatcgccatcggcatgtcatacatcatgctggcaatgtgcgtgtttccctccgattcggtgtcacgcgccctgctgatgggtttgggcggagcgggcttcctgttcctcgggcgaagaacacaggctttggccgccctcaactggaccactttaggcatgctcatggccaatccgcacatgtcacgcagcttcggattcgcactatcatgcacggccgtactcggcctcgtactgttcgcagggccgttaagcgcatggctcacgccgatcatgccagcgttcatcgcgcaaaccatggccatgaccatagccgcgcaactgttcaccctgccgattcaagtgctcatcgaaccggaactgcccgtctactccattccggccaatctggtcgtcgcacccttcgtgggcttttccacactgaccgggcttgccagcctcgccatttcatggatactgcccaatctgggattcatattcgccagcatcgcctcctggggcaccgccattatggaactcatggccctccacctcgggtcaggagaccgcgccaccattccgtggaccggaggcgcgggcggcgcactgctgatcatcgtcgtcgaaatcgtcggatatatggccgtacgacttgtcgacacactcttcacccgcatcacaacaccggaaccaaacctgccgggccgacgcctcatgcgcaatcccgtcgaacgggcgaaagcatggggcgaacgaacccacaacgcgctcaaaaccatgaaatggaacgaatgaatcttgtccaccgatacagcgagattgaatactatgccgaaaccatccgcagcaaccttccacctcatctatggaggcgacccgtacctcaacgagcaaaccgtacgcgacctgcgccaccaatcgcaacgcaaacaccccgacgcggaaaccatcgaactcgacgcaaccaacgccgatcattacgccttcgacgaagcggtaagcccatcactcctatccgaacgatcaatcgtcatcgtatccaacctgcaaaacgccgacgacagactcggcgaaaccatggtcgcctactgcaagcaagccgtcaacaatccaaccgaagccagcatcgtcatctgccaacatgaaggcggcatcaaaggtaaacgactcatcgaccaactcaccaaagccggagcagtcaaagaagccgtggccgacctcaaaaaagccgacgcaaaactcaacttcaccatacaatgcttcgaacgacgcaaccgacgcatcgaacccatggccgcacagcaactcgtagccgtactcggcgacaaaaccggcgaactcgcagccatggcaggccaactctgcttcgacttcgacgacaatcccataacattggaacgcgtcaaccaatacctcaccgccaacccccaagtagacggcttccgcgtggccgacttcgcactctccggacgctcagccgacgccatcatcgccatgcggacttcggtcgaacaaggcaccgcgccaatcgcactcatcggagcgctcgccatgaaactacgcaccatggccaaagcctcagccgtacgctccggcaccatcagcgaagcggaagcgaaaaccaattcatgggtactgaaaaacgccaccagacagctctccggatggacctccgacggcatgagacgatgcatccaaatgctcgcatgggccgacgaacaaagcaaaaccaacggatcggaccctgtctacgcgctggaacgatccatcgaactaatcagcaacaaaggacgaatcaactaacatgaacgaggacaacaccagcaacagcgcggccagcggcaccgccaagaccatcaccgtcgaagcaacaaccggcgaagccatgcacgaactcggcaaacaagtcgcacacctcacccacggcggagacgtcatactcctctcagggccactcggcgcaggaaaaaccaccttcgcacaaggcttcggcgcaggactcaacatcagcgaacccatcgtctcgccaaccttcaccatcgcacgcgaactcaaaggccaattccccagcggtaactccgcccacctcatacacgtcgacgcctaccgactcggcggcaacgcctatgccccaggccaaaatgccatcgaacgactactcgatgaactcgaatccctcggactcgacgaagaactcgaagaccccagcgacaacaccatcatcctcatggaatggggagaacagatggcagccgcgctcgcaccggaacgcctcgaaatccacatcgaccggccgctcaacaccgttagcacagacgaaacaagcagagccgacaacgaactcaccagcaacggcacccgcaccgtaaccttcattcccgtcggcgcatcctggcaaaccttcgacatcacacgcaacaaccgctaaaacaccagcagcaagcacgattccagcatcggttgtacagtagttcccagcttggcataaggagtttccacaaaatgcagacactggtgatcgacacctcatacggctcaaccgtcggcatggtcggacacgaccccatcgtcgaaaccgactcacgcacccacgtcgaaaaactacaggtgaacatcgccacaaccgtggaacaagccggcctcaaaccggaaaacatcgaccgcatcatcgtaggcatcggacctgcacccttcaccggactacgcgcaggaatcgttgcagccaaagcgctcgccttcgccaccggtgcacagcttatcgggcagaatgtgctttccccgcaggtgcttgtgcgcaacgcggagcatgacggccgccatcatctgacgctcgccgtgaacgatgcgcgacgcaagcagctgtatttcacattgttggatggcagcggctatgaggccggtggcagcgcaggcgaagaccatgacgcaaacgttgaaaacggctgtgtggaaaccctgatcgacatggatatcgactatcccgaatcgattgcgaaccgtgtcaacgaggtgctggaacggcttcgccaggccgatccgaacgtggaatatgtggtcgacgtcgtcggccatggagcggcgaaatacgcgcaatcgtgggcaagccttcccgaaggcggcgaagtgcgcgatcaggcgctgctcgacgagggcgcgtccggattggaacgattcgcggccttcgccacttcgcaacagtctttggtgaatccggagccggtcgaaccgttgtatttgcgcaggccggacgtgtcggtgccgaacccgttgaagcatgtactcaaccatgccggcgcggaacgcacggagtgacgatacggcatgatcgttgaccatacaagcatcgatgaacagatcgcagtgccgcagatggccgctttggaagcggacctgttcggcaggggagcgtggagcgaacagtcgattcgccaggaattccaagcgccagcacgcacgtatctgttcgatattgatgatgacggcaagaccgcggattgcgggattgcgggttgcgttgccgtggatgagccggttgctggatcggttgcaggcgattctgctagacaacagcccgttgtgcgcggctatgccggtttctggtatgacggcgacgatgcggaaatcatgacgatcggcgtcggcaggcggttccaacggcagggaatcgcggcttcgttgatggaggcgttgattgcgcgggcacgtgagcagggggccaaacgcatgttgcttgaagtgcgagtcgacaatactccggccttggcattgtacgaacggttcggttttgccaaaatgggattgcgcaaacgctactaccagcccgaaggcatcgacgcgtacaccatgagccttgaccttgagccgaggatcgtcggcttcgcagcagcggaacaataaacagaacaaccaaacggaacagcaagcaaagcagcgaacggagcagcaatgagcggaccaatcgtactcggcatcgaatccacctgcgacgagaccgcggcctcggtagtgcaggggcgcaccctgatttccaacgtcgtcgcatcctccatggatgagcacgcgcgttacgggggtgtgattccagaaattgcgtcacgcgcccacgccgaagcgttcgtgccatgcgtttccaaggcgttggccgatgcgaacatgacgttgtctgacgtcgacgcgatcgccgtgtccgcaggtcctggacttgctggctgcctcgccgttggcgtgtccggcgcgaaatcgcttgcctgggcggcgaataagccgatttacggcatcaaccatgtgatcgggcatattgcggtcacacagttgcagttcggcccgttccccgaagacacgctcgccttgatcgtgtccggcggacacacgtccttgctgcatgttgaggatgtcgcacgtcatatcgacgtggtcggcaccacgcttgatgatgcggccggcgaatgcttcgacaaggtcgctcgcctgctcggtttcccctatccgggcggaccgcatatcgatcgtcatgcgcagttgggcgacccgcatgccatcaaagtgccgcagggactcacccaaggcaaagcgggccagcagcatccgtacgatttcagcttttccggcgtgaaaacggccgtcgcgcgttggatcgaggaacagcaggcgcaaggcaatgagattcccgtcgatgacgtgtgcgcgtcgctggcggattccgtggcgactgtactcgccaagaaggcgatgcgcggctgcgagcagtacgattcgaagacgttgattgtaggaggtggcttctccgcgaattcgcagcttcgtgccaaactgttggaagtcggggccgagcatggggtagaggtgcgtgtgccgcagctcaaactgtgcaccgacaacggtgccatggtggccatgctgggcgtcaacctggtcgaagcgggagtggctccgtcaaacccggatttcgccatcgattcggccatgccgttgacgaagatctccatgtaagattaggccgaaagcatcgtatggaaacgttttgcaagtcgaaacacacatgtgacacgctgaagatttgaaatccacaagttttggtgtagtatttttgtcttgtgcacagcgcattcctgcgtagctcagttggcagagcatccgactgttaatcggacggtcactggttcaagcccagtcgcaggagccatttgaaagcccttggaaatcaagggcttttgtcatattcgaggaatcaacgaagatgcccatacagcatccccgactcagaggtgcaggaaaaatgagctacatccacatcactgaagagaacatcgacaaggaacatatctgctgtgccatgtccggcaagcaaagccttgcgaaaaaagagtggctcaagcagcgtttcaacgaaggtctcgtcttctatcgtagcgaggaacgaggcaaatgcttcatcgaatatattccggcggaaaacgcatgggtgccgatcgatgcggacgggtggatctatatcaactgtctatgggtggccggttctttgaaaggtcatggacattccggtaatctgctgagcgaatgcatccgagacgccaaagagcaggggcgcaaaggcatttgcattctctcagccgagggtcgcaaacgagagttccttgccgatccgaagtttctgtcctacaagggtttcgaagtgaccgacatatctgattgcggcatcaatctcatggccctgccttttgaagagaatgcggagctgccgaaattcaaggaatgcgccaagcatcccgcggtggacgaagacgggttcgtgctctactacaccgatcaatgcccgtttacatgctattgggttccgcgggtgcggcaaacggcggaagagcacaatattccattcaaaacgattcatatcaccgataaagagaccgcccaacgtacgcccgcgccggtcaccacgtatgcgttgtttagggacggcaaattcctcacccaaggcatccagtccgacaaaaagtttctggcattggccggcttgtaacgtcctgaatcttccacccaatgggggaaccttccccgccaagaaggcagttggcgtacggattgttccagcgggtgggtgttttggggactcgggaggcgggctattctctaacacgcatgcaggagacctcgaatttgcgcgtttgacggagactctgctatcggttgcgaggatccagcggatcacggtcgtcgtagaatgcgtagatatccagactaggttcttccacgggcaaaacttaagattttcccagcaaacggcgtttaccatgaacacgcaagcaagaaaaacacggcaaatcatggaagggagtccatatgtgcactggtgttcgtttctccgacgatgagggaaacacatatttcggccgtaatctcgactggagcttctcctacggcgagaccattctggtcactccgcgaggctaccggtatgactatgcgtatggggccaaaggcaagagcgagccgaatgcggtgatcggcgtgggcgtggttatggccgatcgccccatgtatttcgattgcgccaacgagcacggcttggccatcgccggattgaacttccccggatacgcctccttcgcgcacgaaccggtcgagggagccgaaaacgtcgccactttcgaattcccgctgtgggtggcacgcaatttcgacagtgtcgacgaagtcgaagaggcgttgaaggacgtgacgctcgtttcgcaggtcgtgcccggccagcaggagtccttgctgcactggttcattggcgatggcacccgtagcatcgtcatcgagcagatggctgatggcatgcatgttcatcatgacgatgtggatgtgctcaccaatcaaccgaccttcgacttccatatggaaaacctgcgcaactacatgtgcgtgagcaacgaaatggcggagccgaccacttggggcaaggcggaactgagcgcatggggcgccggcgtgagcatgcacggcattcccggtgacgtgagttcgccgtcgcgtttcgtacgtgtcgcctacaccaacacgcactatccacagcagaacaacgagtccgccaatgtgtctcgtctgttccacacgctggcctccgtacagatggttgaaggcatgtccaagatgggcaacggccagttcgagcgcacgctgttcaccagcggttattccggaaagactaacacgtattacatgaacacgtatgaggatccggcgatccgctcgtttgccatgtccgacttcgacatggattcgagcgagctgatcaccgccgattgattccgggaatttcgagttcgaagattccgcagtaatcgcactatgtgcgatggcataaaaggacgcaacgtcgcagccggcgttgcgtccttttaatcagtaaaactgatgagatttgattaaaaaattaaaatggtcgaggcatgctgtcaaacgtactttcaggcgttttcttcgttatgttccttatgcgaggaagcgaatcgtgacagaacacctgacttacgtaaagcgcaatacattccccaggaaccgaaaccggcgaatgccaccgcgctaagcagctcgcaaatagtgccgatgatgcctcgcgggctgaagaacgtgaatgcctgatagtagaagaacagcaggtagaagttgtagacgattccaatcgccaaagcagacagaatggtgacgccgagcgtccaacgacggtagcggaacagtgcgaataccgcttctgcggctgccgcctgcagcaatgcgattaccaccaggctcacactgtatttcgtgccgagtaccacctcgacgaacgatgcgaccaaaagcacgtaggccgaagctcccggcttgcgcacgatcagagagcccagcgtggcggggaagtagaacaaagcatgaagtagcgccgctgaaccaggaagaatcaaagtcatcaacggaaaaagaccatacgacaggccgtcgaacacccaaaacatcactcccgacatcacgccgaccgccgcgccgaccgcgatatcgaccacacgccatgtgagggccttgtgtattccttggtttgttttcaaaggctgccttacctgcttcgacagcttcgcgtctgtattatgaataacggttttagagaatggcttcgccataatgataatgaatccttgcgttggtcgatgccgtgcactgtgagtcggagatcgcggcagtcgccgtgggccgttcctcgacctgcgcggctcgggcaggaacgacgaaaggtattatacgacgtgttgtttgccgaatacgcatcatggatttccctgtatccaaaatatcgttacaaatattccaaatccgggcgtacggtccagtccagtacatctaatccgcacgatttcgttcaactcagcagcataagagctttttgttgtgaggtggcattcgtccaaaacagcgtggtctgatgttccttacgatgaacacgtaagttacgctttgcagacgcaacttagctaattgtcaggattacatgttcttttgctatgagatagcatgcaacacgccaattagacttcaagcactttaagtttttacagtgcagggtatgagcactacaacatggcatacgattcgtgaagcatccatgatttccggacttcccgaatccactttgcgctactacgagcaaatcggtatcattgccccgatcgcacgtgacccaagttctggccatcgcgcctacaccgacgaagacattcaatcgttggtcactatttcctgcttgtctgcgactggcatgccgcttgacgccatgcgcgagtatctgaaaaaccgtttcgacggaaccgaaggtgcgcgcaggcaaatggcgctactggacgcgcaggcgttgcgtttggccgcaaaagccgaaagcatccgcatgcagcaagcctatgtttcccttaaaacattgtattggcgtgccgtggcggaaggccatgacgacgaagcgcaacgacttctggaggaaaaccacgatgtcatcgaaacagtgaaaaaacagattcgtagcaaggctgacgcataagtcgaggcgtcatcgcagacgttaccttaattcaattcgtataacaaaggagcaactcatgaaggcagcgatcttcaagggagtcaagcagatggcatgcgaagagcatgccgaaccgaccatcatcgatgggggagatgccatcatccgcgtggtacgcgcatgcgtgtgcggatccgacctgtggttctaccgcgacggcagcaaggaacccaacactcaggccggacatgaggccatcggcgtggtcgagcagatcggcgacgacgtgaccgtggccaagccgggcgatttcgtgatcgtaccgttcccgttcagctgcggcaagtgcccggtatgcaaggccggtttcgaatccagctgcccccacggcggatatttcggagacgagggattgggctgtcaggcggaatacctgcgcgttcccgaggccgatggcacgctggtggtcgttccgggcgacgcgaagagcttctccgacgaaatgctcgcatcgctgctcaccctctctgacgtgatgtcgaccggttaccatgcggctgcttccgccgaaatcaagccgggagacaccgcagtcgtgttcggcgacggtgcggtcggcctgtgcggagtgctgtccgccaagctgatgggcgccacccgcatcatttccatgagccgccatgccgaccgccaacgtatcgcacgcgaattcggtgccaccgatttcgtggaggaacgtggcgacgaggctgtagccaaggtactggaaatgactgatggttacggtgccgacgccgtgcttgaatgcgtagggtccgcattgtcgaacgacactgccatgaaggttgcgcgtgcgggcgctgtagtcgggcgcgttggcttgccgcacggcgtggaagccgatattccaggactgttctaccgcaacgttggtctgcgcggcggtccggcaccggtgcgcacgtacgatctgcagcgactgctcaaggaagtgctcgacggcaacatcaatcccggcatcgtctacacctccgaatacacgctcgacgatattcaggaagcgtacgcggccatggacgagcgccgcaccgtaaagtcgctgctgcgcatcagtgaggtctgagcaatataccgacgatagaataagcgcaaatcaaacgaaaggaagcaaatcttgtttgaagagctgcacaaacggatgaattcgttctggaataatgacaggacattgtcgcaaaccgatccggaattcattgaattcttctcgaatttcgcttatgacgaagtggtgaacgaaccgggagcgaaccatcctgatttggatgacaaaacccgctctttggccattcttgccgtgctggtcggatgccaaggcttggatgctttcgaaatgatgctgccggtggcctacgaaaccggactgtcgtccatcgccatcaaggaaatggtgtatcaggcgaccgcatactgtggtttcggcaaaaccctgccgttcctgaagagactcaacaactttctcggcgcggccaacgtgcatcttccgcttgaaccgcaaggcaccaccacgccggaaacgcgtgccagggcgggcgaagacaagcagatcgaaatcttcggtgaaggaatgcgtggattcacgcaatccggccccgaagatacgcgacacatcaacaagtggcttgcctgcaactgcttcggcgactactacacgcgcggtggcttgagcacgcgtgagcgtgaaatgatcacgttgtgcttccttgccgcgcagggcggttgcgagccgcagctgacgtctcatgcgaaggccaatatgggcgtaggcaatgagaaggcatttctgattgccgttatttcgcagtgcatgccgtatatcgggtatccgcgtacgctgaatgcgattcgttgcatcaacgatgcagcggagcagatgcaaggctgattgcggtaggatttcgttcgcttcagtacgaaaggggctgtttgccagtcacgattggattggcaaacagccccttatatgttttttacaagcgcactacgcgtgtgcgagcatcactcgccccatacgtccttggcgacggactgcacgagcgcgatcttggcccactgctgctcttcggtaagcttgttgccttcctcggtggacgcgaaaccgcactgggtggacaggcacaagcggtcaagcggcacatactgggccgcttcggcaatgcgagccttgatcacttccggattctcaagttccggcttcttggaagtgatcagaccgagcacaaccttcttatctccggaaaccttggcgagcggctcgaagtcgccggaacgatcatcgtcgaactccaggtagtaggcggcgacgttttccttgccgaaaagcacgtcggacacagtggcgtatccgccggcggaagcccacgtggagtggtaattgccacggcagtcgtgcgtggtgatcaccagatcctctggcagatcctcgatggcagcgttgttcatggcggcatactgttcctgcatggcggcgaactcatcggcggtgtaatgctggttgaagttcggatcacagaacatgccccacgtgcagtcatccagctgaacattgcggcagccggcctcatacaatgccatgatcagaccatggaaggccttggcgttgtcgtcggcaagctcgtcgtaatccttctgggtgtcgccgtagaactcgtgcacggaagcgatgttctccgggcggaacagctccgcatacagctgtgccggagccggaatggtctggcgtgcaatggcggtgtcgtcttcgaactgcttgatgaacttgaaatgctcaacgaacgggtgggccgggtcgaaggcgatcttgctggtcaggcgtgcggattcggcgcgggtctcctcatcgtggaagaaatagcccttgtccgtcgacaccttttccacgccggcgaagccccacatgcagtcgagatgccaccagccacggcggaattcaccgtcggtgatgacgtgcagaccggcggccttctgcttggcgaccagttcggtaatggcattatcttccacggccttgagtgcggcctcgtcaatcttgcctgctgcgaaatcggcgcgagcctgcttgagttctgccggacgcaggtatgagccgaccacgtcggcgcggaacggcgcgttctgggaatacgtcattggatgctccttgttgtgctgtcagtgaaaatacctagggaagactagtcaatccttcagaaaaatgcacgattacgtcgggaatatgagacgggcgcattatagtgttttgcgattgaacgacatatgatt

SEQ ID NO: 75 - DNA, 362941 bp, Bifidobacterium pseudocatenulatum
gtcagacagtttgtctgacagccacccaacccatcactttcagtcgtctatctcgatcgcatgtaccgttacctcttcgtcttccgaggcattggatttcttgaattccgggcgaagctccatgccgtcctcatcgaattcgccattcagattgcgtaccagcacattggccaatcgaccacccataggcctgaatgtcgcataggttatcgccccggaaatggcaccaccgacaacgggcacgaccttggtaacggttttcccgaccgactccttcactacctgtttgccgaccagcacgccgacctttttgaccagcgggtaccaggtcgttttcataagagcctgttgcgcgaccttcttgcccatgttcttaccgacttccttggcaagctttcctaccagcatcgccgcacctgacgccccgaacatcacacccaaatacgcaaggactcggactttggctccttcgttcaattccgactcgtcggtgaacaaatcatcctctccgaagagataggcgattttctgcgccaggttgatcgcaaaaaaccaaagtattgagccacatcggcacctccagcggcaacggcggcagggccaccgggaattcctgccacaaaggcggcgagagtggtctgattcgtcgacttcttaatcaccccatccgctttcctgcgcaacgactccaccgtatatacgtgttgcgggccatgctccagaatctcatcgagatattccaaatcggcgaattgctgtcgcagaaacgcttccctatcaaccctaataaccggaagcttcgcaacgcttccgatcatatttatcgccacatcgtaaagctcttcgtcggttttcttagccatgttctctccactccgataagacgcattgtgcttaacgcccatggtattcgctcctttgtttgctcgatggataacatgcgggcaatccgcattcatcatgggccatgttttctccgcgagcgcgatgggtttccaccggatagaatctgcatccacgttagtaatccgtcaaaacgcgttcgcgcactctcacgcaccaacatcttgattacatacttctgttcatgtacggcatgttcaattacctaaagatatacagtcctgtgtatcagcgcccacccaaggctacgtttacgtcctgaaatgcggtgggcctcttctgtctataacgacggtagaacgttccctaagacacgctagaatcgaccaatcgaagcaactatgctagtgtgaataataacagtagcctccaagcctcttaacaatgctcaaatccggaggctctttttttatcaagccacgcaaggataagtcatgacgaagcagccaaaaacaatacaagagatgatgacgcttctagtcgaagaacgaggcttggatatcaccggattctccgatttcagtaccgtccttcttgattgcaactattacagattgtccggctacttccgagcctttcagattgatccttcccatggcaataatcgctttcgaaacggaacacacattagagatttcatgatcccctatttaatggatgaacagctacgtctactcatccttcgtggaacatcatccttagaacaaacgcttcgggctcatttcgcttactaccttgctcaaaacggaggagcctactcctacacggaactcagctcatataagacaatcaaatattccgatggcaccgaagccagagaagttctaattgagaacattcacaaatggcttgaacgttccagcgaagtatgcattcgccattatcggaataacaacgagcctattcccatatgggcggcggtcgaggcgatgccctttgacactctctcaaaaatgatttcattgcataccaacacaacagctgttgacgaactcaatcagtcgctttctctagggaaaaatcgtcaacgtgctgcgcaaatcattcacagcatggtgtatctacgcaacatttgctcgcaccattgccgtctttggaacagggagattgtccttcctcccccagtccttgatgccacagctgagcgctatggctcatatgcttatgaagaccgctccgtctggaaatctcttattgttctcatggatttaatcgatgaaataaaaaagaattccacatattcatccatgcttataaaacaagctgagtcgaatgataactatttctggggattatgtcatcctaaacggtggcattagacacagccacctgaccaatatttgtcagctccccgaatctcattgtcatgagaaagcccagtatcgaagaaaatgataaatatgacacacctcagataatgcggaacatcggattggaggttatggaattgacgaatatcacacgctgcatttcagccagtctgtcctgcagttcagtggtaatgtatcgttttttcaccaagtcgatctcccgaccaaaagtcgatgcaagatcatcacgcaaagcccactcatcaatcattggattggcggtgtcgtcaaactgatagatgaaatcgatatccgaatccgcatgtccctcccctcgagccatggaaccgaacaggtacagttcattgacatgatgccgcagcgcgataggacgagcaatctccgctatctgctgaggcgtggtgtcccgcgaaatcgcgtcaagcgcatcctgataacgccgggtaaaagcctgtgtcggattccccctcaccgcgcgagacagcacaggagcggtcacgcccatggattccgccacgcttttctgcgagaaacctaatcgcttgcgcttttcgttaagctcatgtattgttcccataccgatatattagcttacaagctaattaccgtctagagcgtcaaacagggacgaactttatccgtaataatcctcatcgcaagccattggcaaagaccgaggcttctcgctcactttcgaacccatctgatgaacatgcacctgattggcgccccccagatattcgttaaaggatacgacaaaacatacgcggtgtatcagctgcggaaacatcagttttttgtttttcacggaattcctctgattagcctccatcagtatgcatgccccgcaatgcttcatcccctcacagccccacatgcgccgcatgatcgcggaccgtgctctcctcatccaagctgacaggtaggaagccactcgaatcatcaataaagtcacaaatcagctgccactggcgacggctgataccgatacgctcgtccggtctcaccataagcaccggtgccgcaggttccagcgattcaatctgcatcttcgccgagaaacagcattcctcgtcatcaatccagacaatcggcaacggctcctgctgtcgccgttcgaaccggacacgtgacataatctccgcgagcttgccggtccatctccgctcgttagtgaccgggtcgtaccagacaacagtccgttcaattcccggatcccaaccaagcatggggtcaagcacccttgaacaatacggttgccatgtggtcagccagttcaattcaacgctgccggaaagggccaggtcatgcatcatgccggcaagctcgcgcgaccaatgcacacggaagcgcccatgccccgtacgcacctgctcgttgcccgtcaggggaaacgcacgctcggaatcgtacagttccttacgtgggtcaccttccttcagccattgcgtatggccgacccctccccgccgaagcaccttatcatcggggaacgcgttcagcacaccgtcgaaatccgtgtaaatcaccgctcgaaccatccgcacctcccggtaagccccaatctgcctcgtcatgtaattattcactactatctaccggacaaatcaagccggcccattttcgctagttgctttatttgtggcactcgaacgccgaaacccgaagtacgagcgttggaattccaacgctcatactcgccataatcgccaaacaatgccacaaacaagccaacaagtgttttggggagggctattcgcgtaatgttgcgctctatcattgataaaggcatccagcaatcgcataccgtaaggaatcacatgcgctatttcacttcggacacgcatttcggccaccctctggtcaccgcactgcgcggattcctgaacaatggcaggctccgcgccgaataccgtgatgtctggcaggcgcagggacgtgccgccgctcacgcgtggatcaaacaatatgtgcgcgacaatcagacgtcgttcaaagcgatctgcgacatcgcacgccatgagaacaccatcatcggcaacatcaacgagctcgtcgggcgcgacgacgagctctggattctcggcgacctctcctaccgctgcaccgtcgaacacacgctcgactgcctgcgccgcatcaactgccgtcatctgcatctaatcatcggcaaccacgaccgcaacttccgcttccgattcaatgacatgctatacgaagacgtgttcgagaccattgatgactactgcgaaatcgacatggaacttcccgttctcgatgaatccggcaaaataacggtggcgaccacgcagcaaagcatcgccatgagccacttccccagactctcggcattggccgaagaacacggcgactggccgagcaactggaacgagttcgccgatatggcgcctaccaccgaaggctggctgctctacggccatacgcatcaggacgttcccgacggcactgatccgcgaagtgtgaacgtgggactcgacgcatgggatttcaagcccgtcagcgaacagcagatcctcgcctggcttgtatcccggtgcgccgaccaatcaaagtgaattccaccctgagcatggatccgggctgtaggatgccgggtcgctggtatttgtcgactccagcactccaggtttgcaaccattcgagtttgggacactgtcggcatgttcccggatcaacattgccgatgatggcggtgactcgagctttgagttcttcggggatgatggccgtccatgccatgttaccacgctgcgccggatcgcctatgaattcttgcggcacgcctttggctgcacgcataaactgcgcttgttcggatggcgccaacggcaggcaattgacgataagttgcgattattctcgattcccacctatcccaccttaggacagacatgagataagcctttcacatgtgagtggcgaatagattcagccgggtctgacttgaccccgactgaatcacatgtatgcgcccgtctgttcaggcaagggactcgtacgcttgcgcatcgaccggttcaagccattcgttgcccatcgcgccaaggtctcctgccggaaccatgaacgccaggtgggagaaggattcgcccggagccgcaccatgccagtgcttggtgtctgcaggaatgcacacggcttcgccagctttgagttccttgggttcctggccttcgatctggtagtagcctcgaccgcccactgcgatgagcacctgggatccgccgtgatgtatgtgccagttgttgcggcatcccggctcgaaggtgacgttgtggatggaaaaatcaggagcgtcgagcaccgacgcaagatagctttgacctacgaaatactgggcaaagccgtcgtttggctctcccatgggaaatgcacttggattttccataatagtcctttcgttgtaatacgcattcattgaacctcgacgaaaatgcagtgtcaatgcataatgagtgacgaacatgcttttccatgcagcaaacgcatatacatataatagaggcaagaggcacgcattaggttcattcgcggaccgagcggtgctatggaaagcaacatttcacacatccaacaggcaaaggagctccatctaatcatgaccgacatgaagtacgcgccgctaggctggtctggcatcaaagtatccaaagtatgccttggcggcatgagcttcggtaaaacctcaccagacttccatcagtggaccatcgaccaacagggaacggaacaagtcatcggccacgccatcgaccgaggtatcaacttcatcgacaccgcgaactgctacgccttcggcacttccgaagaatacattggccaagcgttgcgcaatctcaacatcgcgcgacaccaagttgtgctcgccagcaaagtgtacttcaacgatgggcatctttccaaagaagccatcaaccgcgagatcgacggcacgctcaagcgtttgggcaccgactatctcgacctctatatcatccaccgtttcgactacaccacccccgccgaagaaaccatggaagccctggacgcgctagtcaaagcaggcaaagtacgcgcattgggcgccagcgaaatgtatgcgtatcagttccacaacctgcaggccgtggccgacgccaatgggtggacccgattcaccagcatgcagtgccactacaatctgctctaccgcgaagacgaacgcgagctcatccccgtatgccagcagtacgacgttgctttgacgccctactctcctatggcttccggacatctggcacgcccgacatggaattcgaattccacccgcggcaccactgacggcaccatgcgcaacaagtatgatcaagcgcaagcccaagacatgcccatcgtcgaacgtgtgcttgaagtagccgaacaccacggagtgcccatggctcaggttgcgcttgcatggcactgggccaagggtgtgactgcacctatcgtgggctgttcgaagccggaacgcgtggatgatgccatcgccgcgttgaacgttcagcttacggaagatgatattgcctacatcgaggagccgtacaccgcgcacgaattggtcgggccgctttcccgccccggcgaaaaggccttggccggcaccctggcgcccacgctcaaggaaacaacccgaaactaaaaccacatgtggcggtatctgccttatatatggcagatttcgctccccgtctccacgtatctcgcctatatatggcagatagcaccggacagcctcgcaaatctgccatatatagttgagttagaggccgagaccctccacccaagaagtcacttcgtcggccgatacgctggacgagaacctctgaccatcctgccagtcgccagctcccgccatatccgccaaatcagaaccgctgctccccaacggagatgacgcagaagtggcgaacggaatgactttctcgccggtgaagtcattgtcagtcacaaaatgattgaccggccatacggccccgccccaccagatcggatacccgatgaatacagtgtcgtacttatcccacccatctggcgaggtaacgttcaaaggaatatcgcgcaggctttcatcattatgctcgctgttcactcgactgaattcgtcgttccagttcagatcaccactggaatattcccgctccggggtgagctcgaacaaatcaccgtccgccgcatccgcaatggccttggccacgtcggcggtgtgacccgtagcggaataataggccacgagcacatgacttccactctgccggcctccccgcgcattcggctgtgagctggtggaacaacttgccgccgtgcaggattccatcgactacatcgactacaaacaggagttctatgacggcgtgcttgcaggaacaaccgaatactacagcaatctcatcgacgtaaacggcggtacagaaacagatccgaccgcctgcgagcgtctgctcgactgagtactccattttacgcgcaaagccatgagctctctcaacatgtagttaaaaaacatacgtcagcattaaatactaaatcagactgcttacacgtggccacgcaaccaatctgattctctatcggctaaaaactcctcacaatcataagtcgcgcagatccacgactgcatcccacgatatgcatgtccgcgcagccccctacacgtcggaatcggaaaagtcgctaaagtcatccaaagatgacacccgcttgcaaataactatacggatattccactcgtggcagactggcgttgtgtataggagggaaaatgaaactaatcgccatactgttgtccatcgtcatgacgggtgcgcctaactccatgactaatcaaggtagtctttttacaccagcaaacgttctcaatatgtattctgcagagatataccccaagtgcccgccaatcctacactggctctgccgagtcttctgacatgatgacaggaaaacgcgcatgaaactgccatgctcctttttcagaagatgttttagcaaatcctcctatggacttaatccatttcatatgtagcgacaaaccgcttccggacaccggcttgtcaggaaataagttctttgacgaaatatcattcacctgatccacatgaattaaatcatcgtcatcccaaaaaacaatgagacggtattcacctcctggacttccatgcacagcgatatttgtatatagctcatgaatcaaagaaaaaacctcacgggaaaaagcatcatcaagattcttcaaatcttttagcgcaattctcgtctttccatgaaatccgagttccttcaggaaggaatccccttgctcacctacaatttgcaatccagagagactcatattgtccgcttgtactgattccgtctttccaccattcattaaatcaacaacagatcgcatctcatccaaagtttctacgacgagagccctcacttctcttatttctttctcgtcaaaggttttgttcttctcagcatccaagattagaccgtccagcaaaattgccatgtatgccaagttaccagccactgaatcatgaattcggctggctaccacgctctcttttcgcaggtattcgacgtgctgacttaatttttcataccttagtttgttttgtttgagctgggcagcaagttctttccacgcaaacgtttttccgacgaagtatgcaaagaacatgacaagaattaacatgaaatactcattggccgccacaccatcagcattaaagcgccacattcgaaccaatgccaccgcgaacggatacagcatcccccacaacgactcaattcgcagccccgcataccccagagccaaccaagttccccataaaaagcttggaccaccgtcatctggaataagacagcaaatcacaaaagtaaaaaaatgatattgcaacatataatcggccgccgcggcatcaggacaacagctaatacatgcacgcatacgaggaaaaatgtcatcacacccgcagaagggaaaaacagtatttccgcaatagtcatgatgacacaaaccgctacaagcagatattggaggtgaaatacgcaccatgaaataaatggatttactcttttagtactcacgttcattaatttccatccattgaattactgcttgagtcctatttttagcccctaatttcttcatgacccttcgaatatacgttttcactgtaggttcccctatgccaagcttgatgccgatctcctttgaggtaaaacccagggaacacagccccataacctctcgttcccttttcgcaaacgtttcatagttgacatttccacttttggcagtcaataatctctcatgcgactcctgcgcactttcggaagatgcatatttaacatccgcccgccgcccattcactattgcacataagacatggcaaagacctttcacattcgccttatccacaagacagctcgctccgttttccagagcaggcacacagtaacggtccagagaaaaagcagtcatgcccactaaatcaacctgagcagtctcctcacgaatggtccggcacacatcgcaaccgctcattccctctagagacatatccacaagcaatacatcaggacgcgtccgcgagttaagactcttactcaccgcggtcagaccatccgatacagcccaacacacgttagcctgcggaagaatacgctcaatcatcatcttcataacaccaagcgtcaatctgtcattgtccacgatagcgattcttattcgttttcccaaatacatcgtcactcaccttcacccctaagcatacaaatatagccacgcattgcatcacgtacaggccatcacccagccagcagcaatagctattttcaaacacggaaaagcgaaaaatcctcattttccagaaccggcatccaagatccccattcccctgatcgcccagaatcacttaacgctaaaagcacaccggccgatcccgtccccaaatccatggaacacttgtatccataaagtcccgggaaaacaatgtttccattgttcttcatcaggtaaagattcaatccatcaataatccgctcccacagctcatcatcaatacctaagtcgcgcaacgctattgcagcaggcaacagtcccacataacccccgaataagccaccattaaacgtgcaaaccatatctgaaccttgggaaagccttctaagaaactcctcattaaggaattccattgactcattaccatctttatagacttcaataaaagctagggccacaccagaagttccacaatccagataaggcattgttctgggtttattcttcaaatgatccacgtaatacatcggacgctccttgttatccgcattggcaagatgcgttagcgtaagacgaaaaatgctttccgcacgggagcgcaaagcatcgtctttcctgcaaagagaagccttccacaggaacagacctgcacccaaccagcccttcattaaggtaaagtccgctttcgaactcagcatgtcttgcgaagttaaaccacaatcgcatctctcatacaccttggaaagaatatacgacaacattttttcttcatgcgagttcctagatgctcccaatgacagaagagccatgccaatgccagacaaaccagagtacaaggaatagtcgtcaatgcctgccaaataatcaatgtgagagattccgatataagaaagcattttatgacattcctcgcgagaaaacacctcatatgcagccatggccacacctaccgtaccgttaaacaatcccgcgcggaacgacataccgtctttcaatttacgtaataccgatatatatttctcccgcgcaatagcataaaaccattccgagttttccaaacatgaagatttcagcaaagccaagctcacaccggcaaaaccagacccaatgctatatttagacatctcatcgccatacattgaaatatcacctttgacaggatattcacctcgcaagtcaagaccagagacaatccctttataaagaagtctcataaaggtttcaatattctcaggatctaaaagcttgtcacaagcctgtaacgctttgtcgataaatggtccatgagacaataacggagtcaagccaagcattcgcgatctgacagaccgaagaaaagaaactgcctcattcccaaagtgcttttgcaccatataatcctgacagaacaacaacgaaggagccagataataaaggggacatatgggaacaaaaaggcggtgcactataaccgcgaaggcataccaatcttgttgttcatagttgcatacagcatcgttggtaaatcctggagtagcgatatctacttgaaaatcttgggaaagttttttcgccgcctcaaaatcaatcagtttaatttctaaagaatcattaatcagcacatttgataagctcaaatctccaaccgcaaatccaattccatgcattttcgcaattgcactttccaatttggttgcgatctctttacaccctcgccaataagaatcagagcaatccgtccgagcagagcatccatcgaaagggaattccattgctatgtactgctgcaaatctcgaccttcaaaaaaatcctcaactaaaaatgcatgattccagacatcaaaacaatcgacagcattcacaacatcagagagcggactcaaggaacgaaggatttgatattcatgcttgattcgatgaaaagcatccaaacatgacctatcactgaccccaacattttttcgcccttctttaaggatatattttttgccgtttcgcgaagcgagatacaccccaccgttattactaaaatggacagcggagtctatttgataatccgttaattttccatttgagtattcaataaaattatatatgtctttttgactatctttttatatcttcttaaatgtccgcaaagccttattttatcggctctacgggcatttttcttttgtggtaaacctcacatatctaggtctatcttcttatattttcgctatcaagcgtggttaaaatcgtggtaaatacttcttatgcgattagacgctgaacctctgattttgcggtatctatggacgcatgagcataccagttcattgtgatactgatatttgaatgccccatgatatactgtaaatctttcgggttcatgttcttgcttgccagccttgtgcagaatgtatggcgtagtgtatgcggtgtgatatgtggcaagggattgtctttgtggtgcttgttgtatttctttaccatacggacaaaaagcatattgtaatcaatggcaactttgggcttgcctttatgattgacaaatagaaagttgccccgtccgtctatcacaaatggttttgtcttttggcgtttcttcataacccgttgaaatgcctgtatcgtttctctgcttaatggcacttgccttgttccgctttttgttttaggcgtttcaatataatagccctgttccttgctctttagtaactggtggtcgataaccacaacctcatggataaaatcaacgtccatgattgtcagtccgcacagttccgagatacgaagtcctgtctttaacagtatcagcacatcatcataatacttgtgatacacattgtccgtcttgatgaatgagagtagggcttgttcctgttcctctgtcaatgcgactttctctttggtatcattttctaggacttcacttaacttgaaatcaaaagggtttttccttacacaatcgtcttgtatggcgatatagaatgacgcttttaacgagcgtttatggttgttaatggtgttgtaggaaaaaccgttctctttcatgcgtaacgcccattctttagcgtcagagggttttatcgtatcaatgctcctagcacctaacttgtcctctttcaataaccgcatgagctgttcccgttgtttctgtgtgcttttcttcacgtttgccctctgtgcgttctgtttggcgtagagttggcagagcgtcattttcttgcctgtgctgtcgataccgtcctcaatatcccgtcttatctgctgttccagttcacgaagtgagggtttttcccgttttccctttggtgtcgggtctgtgggtgtcaatctccaagcatacacatattttgtgtttccaaatgcgtccacatatttatataagtatttcccgtctgttcgttggctctctccagtatgcaggatacgtcctttgctatcccgtcttttttctttcatggtgtctgctcctttccttgttggaaagagccttgatatgacttgtgttcatcataacacatacaaggctcatttgcattagattgcgtccaatttgtcaatgaccttttcaaactgtcggcgtttaatctgtatgcggttgccattcataatgagccagccagcgtccttgttttcctctgccaagcgtcttaacttgttttctccgatacggaaatacttagacgcttcttcaatggtaagggtgtatttttcccatacgggaatatcgttgttattcatcagatcccccctttcccatgttttgtgtcatattggatataagggataaggtcggtgcggtttatcctctgtaaatgtgcggttagtttactggaaagggaattgctgtatcttgccttatcaagcattgttcccactttttccagtccacctaatgcgtcatgttcttccaagaaataaaaacttttgacagcggaaatcacgccaccctctgtgagccattgctgtgtttcttcaagggaattttgctgttttggtacttgcagtttcaagacttccacagcccctaaaaagcgttcccaaaaccgacacgttttccacctgctcttattactttcgtttctgtttggcacgacaaagcgtaggttgtttgccaatagcccgaaagccagttctcccagttccagcggtctgtctttgaatgtcatggcaaaagcatgagccttatcatcacgcagttgcatttctgttcgtttccaactgccgacttcatcaagtgtcttattatgttttgaacagacttccttatctttatcataaaagcggtaggacaatcccgatttaccagcaccgatataaacagtctttgcggtgtcgaaatcatcaaacttgctttcgtcaaagtggtagccctcactattcgagataaattcctctttttcgcatttcttctttatctgctctatggtaaagaatggcttttcgttcttatcatcaatggcaatatcaagtcttgtgaaatggaaattatcccgtccgtatcttcgctcacagcgtcggaacatatccccaaaggtataattcctactgtcgagaatacggaaaatatcatcacaacctctgccggtcataacaagataacagcctaacccttgtgggttatcctctgtttttcttgcgtcccccgatacataaatatctccaatctgccagcgtgcttgataggttttgtatttaatgcttgccggataaacattgaaaatgtcagtcggtaaacctaaaatgtgcatgattacatcttcagcggttgcagtatcaaatacaatactgatgtaatcaatcttaacggataaatttttgtgtgtagttatagtgcattgctcctttcgtatgccccattttttgcggggtaaaaatcatgttttgtcctttatttatcacagtttctaggtactatgacatgtatgcgcagggcggtgttacatatacgccctttacgaacgcctaaaggcgttccctttcttcctgtgtctgatccgttcttaacgctcacgagccttgtaaggctcgtggctaaacggaacagccccagtcagaaaccttattttcggtttgatagtccatacttattcatgctatcaaagtgaaaatacatcttttctatgcttactcaagcgtgtgattgaccctagcgtgcttaatcactctatctgatacgataataacgccattagaattacttgtcaagaagtttttgttgacttttcgatatatattaagtatgatatgcttataaataccaaaaaagcaatgaaaggagtgtttatactaagtcatggagcattacgaaaagaaaatcagtttcttaggagagaacatacagaccataaggaaacacagaggaatgaaacaacaggaactggcggacaaaatcggtatcaatatgcagagcctttctaagattgaacgtggcgtgaattatcctacctttgatacgctggaaaagataatggacgtgctgggagtaacacccaatgaattattgtcgggagaatggaagtatatcgaccacaccgagccttacatcatggatattatcaaacgggaacaggactttaatgtttccttagattatctgtctgaaaatgaatttttcaatgatgaaaaagaatacagattttacaagatatataaactcatacagtatattcataactacattaccaatgaggttacggagttggaagaacttatggaaatcaagcagttgatacagcgtcagaaaatagaacgcatgatgaaagtacataaggaaatgcgagggttagaccgatacagagaacaaccgaaagaatacaaatatcacaatccttatgatgactggatattccgtcaacttgcagatattgataacagaaaaaacattcctaatacttctccacaagtagattttaatgagggagattatgaagattatctaaaggcgaaatggaacagaggtctttgatttcctcttgcatggaagatacagcaaacaaaaagcccagtaaagagtgcaaagcaccaccaatggtggcaaggctcttgacagggttttttcttttctgtgttagataatcaagaggagataaaggaatggagcacctgaattggagtacttcaattcaggtgaaagaacatcaaaaactttgattacaaatactgtacataaattgatatgtaaaggcaaaggatattgcgttgaagaataagggtaatcagaacgcaagcagtccacagaaccctacaccgcagggacagccgagaaaataacttacaattcggttttaaggaaatgatttaagaaaagttttcgttttatttctgtaaatcttcaaaaatgtatgatattatctatctttgaaagaggtgtgtattatgaagaatgagaaaaaaattacagtagcattacttattgtttatctattagttttatcatggattattttatttaagttacaattttcattttctgcattagaccatataagagaaataaacttgattccttttggtggttcggttattgtaaatggaaaaattgactttgatgaaattataaataatgccattgtttttattcctgtgggtgcatattttagtttgcttttcaaaaataaatcagctttaaaagcaataggttctgtttttggaattagcttcatatatgagataattcagtttatatttgctatcggagcaagtgatattacagatttaatcagcaacacattagggggtataattggagttgcattagtatatgtattatctattgttctaaaggataaaacgcataagatattaaatcggatagcaatggtatgtactgtattagtggttgtctttttatttatgcttcttgctgtaaataatatattttaataccagatacagataagaatatcgaaataatgttactgtatgagcagttagtcttaggattgactgcttttttcgtacctagaaaggaatgatgaaatgatgtgctgttagagctgttcaataagattatcggtgcataaaattttattgtggtgctgatacgagaatggtataatatggatatgaagaaagcgacatattagaagttgtggaggtggtcaattatggaaaaaaaccaaaaagaaaattggataatagcaatcgccgttgctatcatttatttaacagtaagtattctctttgatttatgggctttttcttggattatatgggttgcctatgcaatttatagatttatcgtaagatagttgacttccagcttgacaattttatatccatatatacaaggtagttagtcttaggattgaggtgttctattatgaatgagagagaaaaaatcattcacttatggttcgatatgtggcttaaacagcaagatttaggaatggatagaattttcacagaagatgttgtttatacggaaagctggtgtcctaaatatgaaaaccttaaaacagtaaaacattggtttagcgaatggaatactcgtggtaaagttattatttgggatattaagcagttctttcataagggaaatcaaactgttgtagagtggtattttaaaaatgaaatgaatacaggaagtattgaagaatttgacggtatttccttaattgaatggacagaagataacaaaatcaaatcattaaaagaatatggttgcaatttgaataaccacaatccatatcagcacagcgagaaccctcaatttagagatgaaaaaataagctggttttaaaacttaatcaaattatatctatacacacaaagcagttagtcttaggattgattgctttttaacaaaagacaccgtttaagtgttaaaggtgtctttttagtgctattttattgtcatatcaaggctcattcaatcgtggtaaattcgtggtaaattgaataattttctatacttcaaagtgcttgaaagtatggtgtttatgcggataatcaaaaatcagatataaaatttgatattaaataattattctctttaacatatataggttcatcaacgaaagaaggcaaggaatacagcggtaattctttatccggtattaaatcaccctgaggagtcactatcacaggtacattcttttcgtttgaaaagcgcggcttcagagcaccatatctgaaaaatacattactattttgccattgtttatcagttaagatataaggaccatcatcatatttacaaacaatggtttttaaatcttttagtagctgaataaaaatatgttcagaactggggtaaatagttatgaatttacctgactcaagtctatccgcatattttccattcgcctgaatgaaacaagttctacttgaaagatatttaaaagaaatagatttaacgaaaagatattcagcaacatcatagagaacattctgagcatcataaattgtagaagtgatatgaattttccaaccttgaggaggaaaagagtacatcagacaattgacataagtccaatgcccatcagacctaacgccccattgctctgagttgtcattcgtcggcaaaacataagcatcttcacaagcataaacaggttcgctatagtatatggtctccttatctgccgagaaacggaggtaatcatccgccgagtaaccaaccatcacaattccctcttcccctatatcaatccttcaagagttgattttgaacaaaaaatctatacgctggacatctttcaatgagctctcgatgatccccctgatccaaaagataaccatcttcaataaagaaaataacgtctgagtctattatcgtagacaagcgatgtgaaatgacaattgaaatatcatactcatgcgatcttaataggttatcaagcacacgtctttctgtcttcacatcaagattcgacgttgcctcatccaaaataagtatcggagctttccttaaacaagctctcgcaatctgcaatctctgtcgctgtccaccagacaaagacatcccctgctcaccaacactcttttccaaatcaccaacggaaataatttcatctaagcaagcatttttcaaacatttattaatgtctttttctgatggcacaaaatcaagaccaaaaaataaattttctttaattgttgtagagaaaaggagattatcttgagagacgacagtaaaccaccttctccactcttctagatgctgcccatcaagcaagctctcattgatagcaatggctccagaatttgcactatatagacctgttattgtattaataatagtcgttttcccagatccagatggtccaataattgcatatcgaccacccttttccaacctcatactaacatcatgaagaacttcattatcattgtaaccaaatgaaacgcttttcagttccaaataatcaacattattatacgcaaagttttccatatctacttctcttgagatccgatgacacggttgattctttttaaggaacctttgattgtttgacaactcaaataaaaggtaaataaaccacctactggagtaaccagctgaaagaataacattacatatgcaacaaacgaaccgtatgtcaagagatgtacgtccatcagatgaacaccatagcaaacaatgaccccagtacaaaaaatcgaaatcagattttgaacgggcgtaacaaaagaatatactttgtcattcaagagattaacttcttttatttcatttactcgtttcttgaattttagaagcatacatctctctgcattacataacttaacagtgcgcatacttcgcactatttctgaagtaaacgtatttaatttaccaattctctcttgcagcatcatcgcatttctgttattaaatatacctaagggaacagccagtatcatcactgcaggaaagataattagaaccaaaatagatagtctgtagttaattacagtaagagcaacgacggaaaacagtatattgataacactcgaaacaaactgaggaatactagccgccacaaaattcctgaccagagagatatcatatactattccactggcgatttcaccgctattttcattgtcaaaaaagagcatatctttctcaaaaattatatccatagcctgaatacgcaattccgccacatgaagatcggcctcagttgaaattagcaatccaccaattgcacacaatatgaattgcgccgcaaaaagaaaagggaatacatacagtaaactaagatcaaattttttattatctataaaatcttttatcaaaagaggaacaaagaatgataacgtcgatccagcgatactgcaaaccacgccaagaatcattctcttgctaattcgcataaatttaagcatcagatttttccgccaaatattttgtattagttttaagcaactttcctttactgcctattctaggtttaacatcctcatcaccaacttcttcaggttttaatcctaagctttcaacaaaagcatctgataagtcatcaagcgccatatccttcattgaccaaattctcttatttaccctaatcaatggcgtcgcaaacccctccctccctggagctattaggtcgcttcgtagtattgtgtaatcattacttttttcaatccattcatcgtactgtccatttaaactttcctttgcaatttctctagatattcccgctttaatcgcttgttcgattatcttttcatcagacatttctacataatctacttctgaaggctggaacttttcatcaaatatttctgaaatgaatgcaacgacatgctttggatctttttctgaaatgtaggctatggatcccgatactctggccgaataatggtcagatgaacacttgtctaaaaaaatcacaggatgaatttcaagcttaatctgaccactcgtatacatttttcctatatcatcatttaatgttctatcaatttgtgcacaagccggacataggggatctaaataaaattctacagtcggaatatctttttttgacccaacttgcaccagtagcccgccatcatttgttgcgtttgtaggttttcttttcacttctgataatgactcatacgctttttttatatctttagcgtcacttgcactgtttctagacatgaaaagcccaataaatgcactggcgagaagtataataattataaatacagtaaacaatccgagaattgtttgcttttctctttcattcaatcttttcattacagcatccatctatcaaaatggctatctgttaacttcaaaacagatagccactgcagtttaaaactgttgctcttctacttcagcagaaccaactccacgaactatgccaatgatgcgtattcggatcacaattaggatccgtcgaacaatttccatgcgtgtcaacacatggtggccttttagaggtcatacttgcaggttgcgcaatcaaagcctgtaaactgagcaaatccttcatttccactcctttgaacttccagactctcatcacagcgaaacagatagaagtccagaaacatttcttccactgacgaaacccagtttgacacttttctcaatttcgtgtcttattcactctcttatgtcatcccttagatgacatttcaagccatatatggatctaccatttttgacatgtaacggctcgtttttcatgatgggttacagacatcattgtctgtaacccatcacattgcgaaacggccatcagaacctagaaatcagccctagaaaggactaggcatactctcttcacttgttgccgtccaaaattgccgatagatcgacaacccaaataagtgaaagctgtccatatactgaagcttttccgaaaatgtcactttccatacaaggcagaaacgttcagcagcgcccctcatataggaagaaggaaagtgcaccatcttccaagccaccctgcgtgaaggagtccctgcgtacagtacattccgctttacgcgtcaaaccacggtaatcataaaacccgtaatcgcaggtagtgtcagtgaagaggaaatactcgttcattccagcatcacgaaacacgtcaagcatgtgattgaacagcttacgaccgacgcccataccccgcgcttccggagaaaccacgaacagcgttacctcagcctgatagcttttgccggtatctcgcttcaacatttcatcggcctgcaaaatcgcaatctggtcggcaagtcctcgacggccatccttgcttgccaacaagggcaacgccaagcaatttcgcgtaatagcatgacgtatcctctgcgctgtggtaacacgggatctcaacgagcccaataccacgccaagcacccgaccatcacgttcagcgaccgtagcctcggtggtgcgggaaagaaaatcatgcatgtcaattgccgcaagtcggtgcatattgcgcagacgaatcgccttgcgcaacttgtactcacgcaacccgcgctcatcgttcggaacattcccgttatcatccgactcatcatccgcataccaagcttgtcgaacaagctcttcaagcgcaggaaaatccgtgcgacgcatcgtccgaagcataattgtttctgaagtcatgctcccccatcctagccgcagccatgccaaagctccgttcatggatggcataatgcacatagtattgcgatagcaggaatgcgcaggatttgttggcattggcgtgtgacgcttgggggtctggggtcacacgcttaggatgagacaggattgcgtgcgacgcgcaatgaatgagaggttcatcatggcaatgttgattagacgaattacaggcactctatgcttagtacttgccgtggcatgcgcatgttacgctttcgccgtgcgcaatacacattccggcacgagtttctggattgtttggctagcgttcgcagttttgttcgcgatactcggattcggcctgctcttccggtggtggacgatattgccaagactggtcagaggcatcttgattgcggtcgcgtgtattggtctggtcgcgttcggcacggtggaaggttgcatcgtcagtaaaatgcatgcgcaaggcaaaccggatcttgattatgtggtggttctcggcgcccaagtgcgtaagtccggcccgagccttgtacttcgctaccgtctcgacaaggccatcgaatacttggatgagaatccgaataccatctgcatcgtttccggcggaaaaggaccgaatgaaccgttccccgaagcccaaggcatggctgactatcttaaggaacatggtattgccgaacagcgcattcttgaggagccggattcaaaaaccactgaggaaaacatcgtcaacagcaaaaagatgatcaacgacgataatgcttccataggcgtgatcaccaataatttccacatgttccgcgcgttgcagattgccgacaaatatggtttggacaacgcccaaggcattgcggccggctctcccccggacatgctcgtcaacaatatggttcgcgagtttttcgccgaaatcaaattcctgctgtagctcacgtttcggcaatctttttgctctggttaaggtgccgaaccgaatacgaatacattgaggggtggaatccatattagattccacccctcaacgccctagaaagatgactcttacgagtcagaagctatcgatcgaagctcactcttcggaagcaagctcgtcagccacagcggcagctgcagaagcagcttcgacgctctcggcttcttcatcttcagcggcttcaccgaggaaggcgctcaggtccagggtttcgccctcggacttgaaggtcacggcgcgcatgccggcgagcaggcccttggaacgaccgacttcctgcactgcggagccgagctggccgttgcgcatgatggcctggatgaaggcgttcggatccatgccgtactgctgggcgatggaagcgaggaagttgaacacgtcggcctgggagaccttgacgtccagcttctcggcgagcacgtcgagcaccatctggtcgcgcagttccttttcgacggtttcttcggcttctgccttctgctccttggtggcgttggccggatcagcggtcacgcccttgagctgctgctcaaccatttcagccttgacgcccttcggcaccggaatctccaggccctcttcgagcttggcgatgaaagcgtcacgagctgcggtggcctgacgaccttcggcatcctgggaagcggccttcttgaggtcttccttcagctcgtcgagggtgtcgaactcagaggcttcagaagcgaagtcgtcgtcgagttccggcagctcttcagccttgacggagttgaccttgaccttgacctgagccttctcgccttcgtgctcgcctgcttccaaggtaccttcgaaggtggtctcttcgccggcggacaggccttcgagagcctcatccagaccgtcaagcatggtttcggagccgagctcgtagctcacgccttcctgggagtcgaccacttcgccgtcgatttcggcggtcaggtcgatgttggcatagtcacccttggcggccgggcgatccacacccacgagggtgccgaaacgctggcgcagggcttccagacggttgttgatgtcttcgtcggtgatttcggccttggcgacctcgatctccatgccgtcgatttccggcagttcgatgtccgggcgacgctcaacggtggccacgaacttcagcttggtctcgtccttggcggattccggaacttcctgaacgtcgatttccggctgggccatcggacggatgcccttttcttcgagagccttggagtacagctccggcacaccgttgttcacggcttcgccagcaacggcaccgaagccgatgcgctggtcgatgatcttgccgggcacgtggcccttgcggaagccaggcacgttgacctgcttggcgatttccttgcgagcattgtcgagatacgggttgaactcttccggatcaacggtgacggtgagcttcaccttggtcggctcaagattcctgacgctgattttcacgcttgcgctcctgaaaaatacggttcttcacatttctgccgttaggcaacctctacatgatagcgcgactcacggactctgcaaccagcgcgacctgccacgccctcgcgccctgctcggtgaggaattgcgcaacgtcacgtttttgcggttcgtcggtccaacacaggttgcgcagatactgcggtttgatgatgacgtccgcgggggtacgcgtgtcttccgctatctgcgccaccatcttgcgtgccttgtcaagcgttgcgagacgttccggataacgttccctccagactcgcgtcgcccgtggagcggacgtggtctgtgcttcctgattttgaggattgttgtctatgaccggccattcgctttccggcagatcaagcgcctgttggattattctcttccacatgcttggcttgattttacgttggatcggcgcgtaacgttcgaacattttctcctgttcggcaccggcctggatgcgcacacgctcgttgatggaacgaaccgctctgaattgcgccgcattgtgcggtttgcgctccgccacttcaatgatggtgctgtcggcaagcagcaatgtgggtgcgatatcgtattcgcgagccagttcgtctcgtttgagccacagggcttttgccacggccagagcctggcggtccttcatgatctcagtgatatgcgagatgcgcaaccatgggatgggatgctctttgcgcggcgcggttccttcgcgcagcgcgtaatcgaattcttcctcggcccattcgatcttgccttgcttttgcaactcggcgcgcatggtcgattcgagttcgatcagcagttcaacgtccagcgccgcataattacgccagtcacgcggcaatggacgatatgaccaatcagctgcggaatgctctttcgcaagcgtcaatcccagataatgttcggtgacggcggccaatccgaaacgtttgagccccagcagccgtgcagcgatttccgtatcaaacaaacgtttcggctgcaatcccaaatcaacgaatcccggcagatcctgcaacgaatcatgcagaatccataccgcatcgcccaccgcacgattgaaatcgttccaatcggcaccttccgcagccaatgcctgcggatcaagcaatcctatgccggcaccgtctcttttgaattgcaccaaccaatcgtcatgaccgtatcggaagccagacgcacgttccgcatccgcagccaaagacccatgcgaagacgccaatgcgctgcagtactcgcggaatgccggtagggtgtcgatcacatcgggcacgccctcacgcggctcggcctgcaaccttggctcgtcagtcaacgggataatcctcctcggattgcgtcatggaccggaggaacctagcccacgcgcccacttgggcgcccgcgtcaaggcctccatcggcatagtctagtggcgtccaagacacacgaatctcacacccagtttcgggagcgtcggactgagtgccaaacgtcgtgcttttcgtgactgtgacggttcccgaaacatgttcgacatcgtacgaaccgacacggtccatcatcgcatcccaatacatggacggtatcagacaatcgccttcgcctccagacaacggcaacgcggcgaaagcgacgcaacgccaatgagaatgccagtcatttcggtatttgtgcgaatacaacaccatgatccagcctgtggaacgcgcctcgtcgcattgcatctcaactccaatgccgaaactcgccatggcgcacggcactggaatctcacgatacgacacgcttggtaatcgaggcatgcgttctacggaaagcacggcgtcccataccttgtctggcacgccggagggtcgggtcaacatttgttcaggagggtcggcgtaggcgcacgatcccctacctgtggcacgcgcttcgttgggcgtgccttgaggaaaagcatagatgtccaccatgattcaaggctacggcagagtcgccggttttgcggtatttcacagcatttcgccacgcgtcgaatgtgaagatttttccgcgtggcgaatgctggttcaacaattgcacgaatattcctttttccaatcgctgaggcactttcaaacgattgatttgccggaattgttggctggaatatgcgtggcttcccgtttagtagacggtgaaaccgtgcgattggaattgttccaccacacgctgtttcattgcctcggacggccccttctggtcttccaacgggtagggaatgttgagcatatgccattttggacggccaagctggtggaatccaagcacatcgatatgttccactgcgtcaccgaacgactcgcaaatcttcgccacattctcaacgttttcctcggacgaggtgagcccgggcacaagcacgaaacgcacccaaatcttcttgccggccttggccagacgctgtccgaaatcgatggtcggttgcagaatgccgccagtcacctttttgtaggtttcctcatcgccagacttgacatcaagcagacacaggtcgatatcgtccaccatgtcgtcggtgtaacttgcgccaaggaatccggaagtatcgaggcaggtatgcacccccatctccttggccgcacggaacacacgggaaacaaacgccggttgcatcatggattcgccgcccgagaaggtgataccgccatgcgtcgccttgaaaagatccacatagcgttcgatctttttgaccatggcctcgtaatagacgggcttgccgtcacgcattttccacgtatccggattctggcaatactggcaacgcaatgggcaaccgctcatgaagacggtcatgcgtgttcccggaccgtcgacggacgtgttgatgtcccaggaatgcacgaagccgatatcaccgcttttcagcgcgttgatgcggtcacgccggtccagtccgatcggcgattcgaagcctgacaaccctcccataagcgtttggttgacgtagttttgcgattctctgagcatatgccttgttgtggagcgaaaatgtacgttctcagacatcggtgtcctttcgttgtatctctccaatggtttccccacattgtacagggaaaaccaaggggcgaagctttcacgctccgccccttgcactctaccgcttcacacggtaccgttcagtctcagtcgacgacggcgccctggtggaacgtacgggagatcacgtcgagctgctgctccttggtgagcttgacgaagttcaccgcgtagccggagacgcgcacggtcaggtgcgggtacttttccggatgctcgacggcatcctcgagctgttccttgcgcagcacgttgatgttggcgtggtacagaccgtggccgttgccggcgtccagaatgcccacgaggttgccgatgcgctcatcctcgtcgcggcccaagccatcaggggtgatggtgttggtcagcgagatgccgtcaagagcgtcgttgtagtcgatcttgccgacggagaacatggaaggcagcatgccatgggagtccatgccgttctccgggtttgcgcccggagcatacggggtgcccttcttgtggccggacgggaaggcgccggtggccttgccgtattccacgttggaggtgatggtcaggatggactgggtcgggaccgctccgcggtacaccggcaggcgcttgacctggcccatgacggtggagacaacccacttggcgatctcgtcggcgcgatcatcatcgttgccgtacagcgggaactcaccctcggtgcggtagccgacgatcagatcgtcatcggcgccttcgacgtactcgtcctcatggcccggagtggtcttggcgtccttgttgtagatcgggtagaccttggcgtacttgcatgcggacagggagtcggctgcgatggacaggccggacataccacaaccgagggtacggtacacttccttgtcgtgcagagccatctcgatggactcgtatgcatacttatcgtgcatgtaatggatgatgttcagagccatcacgtaggtctcggacagccattcgagagccttctcgtagttggccttgaccttctcgtaatccaatgagccgtcggattccggctgaatcggctcgataacgcccttgtcgatgacctgcatgccggtcatttcgtcgcggccgccgttgatggcgtacagcagagccttggcggagttcacacgagctgcgaagaactgcatctgcttgcccacgcgcatcggggagacgcagcatgcgatggcggcgtcatcgccccagtgggagcggatttccttgtcggactcgtactggattgccgaggtgtcgatggagatcttggcgcagaagcgcttgtaggcttccggcagcttcggatcccagaagatggtgatgttcggctccgggccaggtccaaggtgctcgagggtcagggtgtcgagcagacggaaggaggtcttggtgaccagcgtacggccatcatcgccgaagcctgcgtcggaccaagtcgcccagtacggatcgccggagaagatcgcgtcgtaatccttggtacgcaggaagcgcacgatacgcaacttcatgaccaggttgtcgatgatctcctgtgcgtcggtctcggtgatcttaccggacttcaggtcacgctcgaagtacacgtcgaagaaggtggagacgcggccgaacgacattgcggcgccatcctggctcttgacggaagcgaggtagcccatgtaggtccactgcactgcttcctgagcggtctgtgccggacgggacaggtcaagaccatattcgttgccgaggttgatcagctgcttcagggccttgatctgctcgtcatgctcctcgcggaagcggatccagtgctcgatctccggctcggtgaagtcgttgcggtacggcacggagtccttgtcacgctgcttgaacttgatcagggtgttcacaccatacagtgccacacgacggtaatcgccgatgatgcggccacggccgtaggcatccggcaggccggtgaggatcttgttgtggcgggcaaccttgatctgcttggtgtacacgccgaagacgccgtcattgtgggtcttgcggtacttggtgaagatcttcttgatttccggatccggctccttgccggcttccttgatggcctgctcgaccatacgccaaccgccgttcggcatcatggcgcgcttgcaaggaacgtcggtctgcagaccgacaaccacattgtcgacttccggagagtcgatgtagccggcgccgaatgcgtcgatgccagccggtgtgtgggtgtcgacgtcgtagacgcgctgcttgcgctctactgccagatagttgtcatcgaggtactgccacaggtgcttggtcttctcggtggcgtcagccaggaaggactcgtcgccctcataaggcgtatagttcttctgaataaagtcacggacatcaatgtccttctgccagttgccctcagcgaagccttcccaagccttagcctgaagctcttccggggagactgccgtcgcatcaactgctgccatttccactccttctgggtgttggtttggcgacgcatcgttacgtcgtcgctagttatcgattctagctgcataaacctgtatagaacctgagtttacgaggaaataaaagtgacatatgtcacacttgcgaagtataagaaaaaatcgcggtgccgtaatccagacaccgcgatttcttatatcgcatcaactacttttcatcggaagaccagcgtttccattcgcgatcctgttcttcccatttgatgttgcgttcctgcacgatcttccatgcatcgagcgcgtcttccctggttttgtatggtcccatacgatggctcgccggtgagatcatgcccagttcaggctgttcggtaaccgtattgaaataccattgcttttccatatcactccttacgaagcgcgtaacgaaacaatagtccgccgctgttctattcgcggaacgcgttggtaatcggcaagcggcggtcacggccgaacgccaatgccgtcacctttggcccaagcgggtattgacggcgcttccattcggcacgatcgaccagtcgcataaccgtgtcgacggtggtctcatcgaaaccgtctgccagaagatcctcacgaccatgcgcatgttcaatgtacattgccaacacctgatcgagcagctcatattccggcagcgaatcggagtctttctgccccgggcgaagttcggcggatggagccttttcaatcgaattgacgggaatcatcacgccgtccggcaaaggagtccccgcagacccctgctcgttgcccacgatatgcagcccgccgatgcccatgccttcggcggcagccttgttgcgccagcgggagatctcccacacacgggtcttgagcagatccttgatcggagcgtatccgccgaccgcatcgccgtaaatcgtggaataaccgcaggcaagctccgacttgttgcccgtggcgacagccagaagccccttggaattcgaatatgccatgacaatcacaccgcgaatacgcgcctgcaggttctcagcggccacaccttcaagatcgagctgcttctggaaggagacgaacagcggttcgatgggctgaatgtcgtagtgcgctccaatattcttcgccagatcggcggcatcatctttcgaaccgtcagacgagtacatgctcggcatggaaatgccatacacgttggctcctcccacggcgtccgcggccatggccgccaccaatgcggagtcgatgccgccggaaaggccaaggcacacgcccttgaaatggttcttggccatataatccttcaagccaagcacgcaggcggtgtacacctcttcgtccggatcgggcttggctgcgatagatccagctttctggcgttcggcagtggtgtcgaggtcgaagaagctcagatcctccatgaacatcggcgaacgttccagcagcgtgccatcggcatcgaccacgaagctgccaccgtcaaacaccagatcgtcttggcctcccacctggttgagatagatcatcggcgcgttcacttcggccgcacggcgtaccgcaaggtcgatgcgggtatcggttttgccttcctcatatggcgaaccgttcatggtgagcagcagatcgatgttctgcttggcgagctccgccacgggaccgccatcctgccagatgtcttcgcaaatggccacgccgatgcgtgcaccgttcacgtcgagtaccatggatttgttgccggggctgaaaatgcggaattcgtcgaacacaccatagttgggcagaaagtgcttgtcgtagccggcccaaaccacgccgtcatgcaatacgacgagtcggttgcgtggcttggatgtctcgcgatcagtgccgaccgtgccgaccaccacaaacaggtcgccaagcccatcggcagccagttcggcggcaagccagctggctttgttccacgcggatttacggaaggtggcccgcagggcgaggtcttcgatgggatatccggtcaatgtcatttccgggaatacgacgacttgcgcgccctgttgcgcggcgcggcggacgtatcgcatgatcttaccggcgttggaatcaaggtctccgacgcaggtgtcgatttgagcgagtgcgaagcgaatgtctgtcatagctgcctaacctaccgttgatttgttgaacgttttattttcttacgatcgcgaattgaaagcggaccgcacgcgtgtcacgaaagttcgttgagcaccgtcagcgccgcgttggcgtagaattccacgccggcctgcagtgattcatccagaccgacgaaatgcgggctatgccaatcggggcagcctttctcgccattggaaccgatgaaggcgaacaccggcatggtgacgggcatgaaatcgcagaaatcctcccccgccatcgaaggatggattggctcgagctgcgcatagtcgcgcacgttgtcagcgacgattttggatagttccatgtcggagacgagcggattctgaaagtcatcccagtcgatgtctgtggtaatgccgtagcccgcggcgatggattggacctgctgcttgaagcgtttctcgaccagttcgccgtcggacttatggaagtagcgtacggttccttggaagctggccttgtccggcacgacattccacacgtggccgccgtgcagttcggtgatggacagcacgagcggatggaatggtgagacattgcggctgacgatggtctgcaaggcgagaatcattgtggcgagcgcctcgataggaccagtgcccttgtgtggatatccggcatgtgagccggcggcatgcagagtaacgtggaatttcacgcagccggccatcatcgggtcggggcctacggcgatctgtccgggcgcataattcggattgttgtgggcgccgatggcggcggatacgtcggcgagcaaccccgcatcgaccatagctttcgcgccgagaccgagctcctcggcaggctggaacagcagtttaatggagcctttgatgcgcttgcggcgttttgcgagccagaatgcggctccgagcatgtaagacatgtgcaggtcgtggccgcaaccgtgcatcacaccgtcgttgacggacgagaacggcaggccagtatcctcttggatgggcagaccgtcgatatcggcgcgcaatgcgatgcgcgggcctggttgctcgccgcggatcaggccgaccacgccggtttcaagcgggttgttgagcacttcgatgtcgtgcgcgcgtagcagtttctcgatataggcacttgtctcgtattccttgaaactgcgctcgggatgtgcgtgcagataatgacggatctcgatgatctccggcgtgatctcaatatgttcgctcatggttgacgattgtaggcgcaaccggacgtttttcctattttcgtgttcgtttttcgtgccgacaatggcgttttccgcagtttttccccgtaagctggatgacgttttgaacggattcacggggagatcggcatgtcatcggacatcaaggctgcgtttttcgatatcgacggcactttgacgagtttcgtcacgcatgtggtgccgcgatccaccatcgacgcattgcatgcgttgcagaaaaaagacgtgaaggtgttcatctgttcggggcgcgcaccctcctatatgggtgtggtgcttgacaccattcccgtcgaatttgatggcattgttggccttaacggccagttctgcacaacacgcgacggcctcgattaccgtcatccaatcgatctgcacgatgtggagatcatcaccgactggctgcaatcgcataccgatgtcgtcgccaattacgcggaaagcaactacgggtatttcaatcgcatcaacgcctctttggaacgtacgtggaacagccttggcaaaaccgcgccgaaaatcgacatatgcaatccgcagcaacgtataggaaaccatcgcacattccagatcagcccatatgtggataaggcaacggaagcggaaatcgccggcatgtgcggcaacgtgcgcggtgtgaggtggcatcccgacttcaccgacctgattcctgcggatggcggcaaggcggtcggcatgcaagtcgtgcttgagcattttggttggtcgagggacaatgcgatcgcgttcggcgatggcggcaacgacgtggatatgctacgtttcgccggcataggcgtggctatgggcaacgccactgacgaaccgaagaccgtagccgattacgtcaccgacagtgtcgacgatgccggaatctcgaatgcattgcatcattttgaaattctgtagaaaaggtttttaagagttttcttgcgattttataagacggttttcgcgaatttctgcgtttttcatgccctttataagtattttcaataagtgaacgccgtgttgccgtcgatggttcctctatattggtcaatcgttgggtccgccgcgtggcaaacgggcggcccgtatagcgaattgagagaggaactcaaccatgcgtaacaagaagcttctcggcgcgctgctcgccgtcaccacgctcgcgaccttcggtctggccggctgcggcgactctggctccaacggcgccgcctccaaggaggatgacaagaccatcaccgtggcggcctccccgaccccgcacgcggaaatcctaaacaaggccgtcaagccgctcgtcgagaaagatggttataagctcgaagtcaaggagttcaccgattacgttcagccgaacaccgccaccgaggatggtgaagtggacgccaactacttccagcacaagccgtacctcgacaacttcaacaaggagaagggcacgcatctggtgtccgtggaaggtatccacttcgagccattcggcctataccctggcaagaccaaggatttgcagaatctgcaggatggcgccaccgtagccgtgccgaacgacgccaccaacgaggcccgtgcgcttctgctgctgcaggatgccggtctgatcaagctgaagaatccgaaggacatcaacgccactccgaaggacgtcacctccaatccgaagaatctgaagttcaaggagcttgaggccgccgtggttccgaccgtcatcaaggatgtcgacatcgcggcactgaacggaaactacgccattcaagccggcttcgacccgaccaaggacacactggtcaccgaaaaggccgacggcctggccgcgaaaacctaccagaacatcctcgtggtgaaggaaggcaacgagaacaccgccaagaccaaggagctcaagaaggctttgaagtccgacgaggtgcgcgactacatcaacaagaactacaagggcgctgtggtgccggtcttctaagacccgcttcggctgcaagaattcaatgccgcaggtatactaccctgcggcattcttattatggaacatcaataggaacaggacattatgacgattcagatcgaccacctgcacaaaagctatggcagtggcgccgaggcgcatgaggtgctgcacgacatcaacctgaccatcgattcgggtgaagtcttcggcatcctcggctcctccggcgcgggcaagtccacgttggtgcgctgcatcaatctgttggaacgtcccacttccggcaaagtgcgcgtcgatggtgaggacatcaccgatgcgaaaggcaaggagctggcggacgtgcgtgccggaatcggcatgatcttccagaatttcagcctgttccagcagcgcaccgtgctgcgcaacgtcacgttcccactggagctcaaccatacgccgaaaaacaagcgcgaggagcgtgcccgctatctgcttgacctggttggattggccgatctggccgaccgttatccgagccagctgtccggcggccaacagcagcgcgtggccatcgcacgcgcgttggccaacaatccgtccatcatgctgtgcgacgaggccaccagcgcactcgactccaccacgactgcgcagatccttgacctgctgcgccgcatcaaccgcgagctcaacgtgacgctggtcatcatcacgcattcgttgtccgtggcacgcaacatctgcgaccgtgtggccatgattgatggcggacgcatcgtggagatgggcgatacggaggaattgttctccaatccgcaaagcgacattctgaaaacactgatcaccgatgcgaaagtggagaaccatcgccataagcatgattccgcttcgtccgatgagcagacggactcgccgaccaaggaagaggtgaagtgaaatgggacagattatctcgcaattcatcgccgattatggcgaactgctggtcgagggagtacgtgacacgatcatcatgaccgcggtagcgacgctactcgcgtatgtgatcggcctacctgtgggcgtactgctcatcacctcagcaaagaagggcatccgcccgaatgcgacactcaacaccgtgctcggctggatcgtgaacatcgtgcgttccgtaccattcatcattcttctggtggccatcatcccgttgacccgactgattgtcggcacttcgctcggcgtgccgggagccatcgtgccgctggtcatcaccgcggcgccgttcgtggcacgcgtggtggagcagtcgctcgccgaagtggacggaagtctggtggaggccgcgcaaagcttcggtgccagcaatctgcagatcgtgttcaaagtgctgctgttcgaaagcctgccgtcgctggtgcgcggcgcagcactgacgttcatcaccctgttcggcttctccgccatggccggcaccgtcggcgcaggcggtttgggcgatatcgccatccgctacggctaccagcgttaccagtacgacgtgatgaccgtggccgtgattctgtgcgtcatcctcgtacagatcgtgcagaccatcggcgacgtggcgtccgaccacatcgaccatcacgagcgctaaaccgacgctttcatgctcctatatgcaagaatcgggtctgaataattgcgttcggatccgattcttgtatgcgaagacactgctacgtggtgcgcttacttgttgagttcaacaactcaatctatgatataacctgtttttactccgcatttccccgactcgatgggagatgatgggattcacggcaagggcactctaccatgcaccgaaattcaagtcagaaaccaatcagtatccggctttaatggcggtgatggtcagctcgccacggttcgtgtacccgagcgccgtgaaaaactcggatatgcaggggcgcacagtggtctcgctcggtccgagccgtttggcgatatcttgtttagtggcgcctagacaagaaggaacaatcccactgccatgtcaggtatggtaatctcaaaacaccgtataacctcgaaccatccagaacatcgataaactacttcaaagacaaaagaggcgcggcacgattgcaggggcattgatgacaggaacactaccaaaacagcataaagcggcgcgcattatcgagcatatcgtccttgtactcgcactggtctgggccggcggctgtaccctcatatggacgcaaatagacatgccccacagcatcgtgaacacgacatcctctgacggcacctgcgaagtggccatcggcaaactgggctcgcccatgttcttcggcccaagcaccatcacgatcaaagtctcctgggacaccgattccaacatcatcggagccgagaacgtcacagaaatcaagacggacctgcacaacgacggcaaatcattggactcggacaacttcaccgtaacctggcacggcaacatctcaaccgtcaccacccatggcgaggaacagtcggaccagagctacacgttcaactggaaataaccaccccggacatcgcgcctctccgagaatagtcctcacggccgagcagatcccacaggggcataagcatgaaaatcatgactaccatcatcatgcgcgcctccgatgataatcgtggtcagctgtttttggccttattccaaggttttcaatttttgggaaacctgccgatcagtctcgtcttccacgaggcacctacaggcacccaaaaataatccgggaacgttccaccaccctgccggcgctcagcgtcttcgccgaccggcacggaaaagtgcaataccccctgtggtttcatgatgttccgcctgagtggtgcccagaagcattcgcccggcagcacgtctccatggcggacaatagacagaacgatacgcggcccatacaaccgtcccagccgccaatggcaccccgaatcccacaggcctattgcagacagcccagatcagctggctcatagtccaaagccgcctgcgacgccaccgtcccaatggcaggaacggtcagctgcgcagtatgatttccgccctgtcggccagttcccgttcgcgcacgcccatagcagacaggatcgcttgtctccgcgacggcatggcggaggtcgcccgtgcgaccaatgcggagaagcgaccgaacaattccaagtaatcgtccttgtcaagcaaatagccaagatcaccgatggcctggtacacgttctcgttagcgcgcccatcgtaccgggcacaatagcagcgctcgtcatgcgcgcacaggttgcggtagaacaccagtctgttgaagatgctgtccaaccgcttgatggtgatgcgccgcggcccgtcgtgcgtgtccgcatacaaaccggtgaaactttcggcgaccgccaatcggacggccggggactggacttggaagaaccataccgtctggccgaaagaaagatggttggccagcacccacaacgggacctggccgttgtggtcttccatgcaatggcggatatacgccttgccgccatagtcgcccctgttgcgcgggttgccgtccaactcaagtatccgcttgaagaccttgtcgatcaacgccacggcgctcggacggcgcctggaatcataatagtcgggattgagatacgggttgacctcgtcggggtgcagcctggtgaactcatgcgcgcatactgccttgagcgcggcctccgcccgtgtgatggcggaaaacaacagttcacgcaactcacggtcgaacaggaacagggcgtacagatcatcgaaacgcgcgcccgtcccgtaccggtcatcaccagcggtcaggcatgcctttcagtcgaggaacaaatccttgtagccattgacgatcggataatagccctcgcgcctgagcacatgaccagcaccggcatcgacagccatgccacgggagcgcaaaatgcgcagctgttcgtccacactcctgtagggcttgcgcaacgacatgaattcgacctcccccaatccggcgatgaaagcactgaggccaccccgcatccacgggatggcctcagcgaaccgaacgaagtccagcttatttcgctgttacagaatagcgccgatcccccgcgaatgcaacccagccggacgtcgagtgagatgaaacctccatatcattattccaaaggcacacgccgatctatcaaggccaccaccagaaaaacccaaacgcctccaaaaagagacgacgcacgcctccacgagactgaattgcgccccgtttgttggacgttgttaattaggatacagccctagaccgcgagggacatgctccggaactcctccggggtgtgtccctcgagtcgcatctgacgccgtctggtgttccaatggatgatgtaggcgtccagttcgcgtttgaactgttcgtacgagtcgaactcccggcctcggtagaactcgtccttcaagtggccgaacacctgctcggtggcggcgttgtccaggcagttgcccttgcggctcatggactggcggatgccgaggcgttcgagctcgccccgccaccattggtgctggtaccgccatcccatgtccgagtgcaggatgggctccgcgccggcgggcaggcgctccgcgagcatggcgagcaggcgcctctgccgcccgaggtccggactgcggctcacgtcccgggcgacgatctccttgctggccatgtcgtacacgggagcgaggtacgccttggagccggcgaccttgaactcggtgacgtcggtgccgagcttggagaacggacgggccgcgtcgaagtcgcgttcgagcaggttatgcacgtgatcgcccgtctcgcccctgtacgagccgtacctcctccacgggttcctggagcggatggcgcatctcagtcccatgcgccgcatgaccccgggcacgctcttggccgacaccttccgtccgaactcgtggaccaggcacatgcgtatctgtcggtggccgcatccgttcggcgtgcgtccccagatctcgccgaccaatggctcgagatcggcccgcgtcacacgctccggatgcgacagctgatagaagtacgtggatctggccagtcccgctatcctcaggaggtggtcgagccggtgtccccgccctgcgagcagtcggacgacggcgcttcgctcgcgccgcgtgacttggacgcccgcagggcccggagtttttccaggtacgcgaccttcgccttcagataggcgacctgttcggcgagctcctgctcgagcgtcggttcgggcttcggtttggatttcgagcctctgggcctgcccttgggcctcggcccgagcgcctccggacctccggcccggtactcgcggcaccagcgttccaggggtgtgacgctcgcgatcccgtgcatggccatgacctccgccttggtcagaccgttctcgacgtggtcgcgcgccgcggcgaccttcgtctcccccacgtataccgtatagtcaggaacgcttttatacctgttcttatcttccgtatgaaccacatacaccgttggataatgaagacgcgttctctcggacatcgatacccccttttatccctatctcgcttatgtatggcagatacacctcggaaaagcgtacttagggggtatgagaacagctgtcatgacaacctgacctgccatatataagcgagatgtctcaggataaagcacggaatctaccatacgtaagcgggataaccaagcttaagcgctcgtacgacacatttttgtgcacaagacatccctccgcaagcgtcatccgaccgcctggtggcacgtttcatatgcacagagaaaacacagcccgcaaacaccacactcgaagcatgacgccagtggctttaaggtagaaccacgccgattctgcttgctgattaaggtaggcgatacgggctttctctggcattcgttgtcgacggaagcccatttggcggatcgcatgttcctccttttcgggtatggagggagtgttcggacactggagtgagcataacgtaatcatgagagagcagacaaaataactacggcagcttcgatcttgcgcgttccgcccctctcggtcttccttcggcgcatctctacgaagtgcttgacggtaatttcttccaaggtgaaatcagctagtggggcaagtgtttctgtatctgtgcattcttggaccatccgtgttcatgatcagtctcgggtcgaatctggtcttctccgacgccaaccctcgcaagattgtaaaacgaggctgcaccacgctcatcgcttttcttctgttgaatatcgtgcgcgatgggattcccgatgtagtcgttgcattgactggccaccccagtactctcgacacgtttggatacgatatttttgcgtccgatattctgggatttgcgggtttcgtattcctgttttttcgcacttgtcaaacattttcacattgcttcattggctacgccgctgatttcgttatgcatgttgacggttaacgatctgattccgccattgcacaatgtccattggactttacgtgcagaagcggcttgtcgcacgcgcttctaaagcctgatttcgcatgcgcacatccgcaaagtcacgcaaatactagttaacgcaatactatttggtggattttgttcccgatgtttttcgtatagcaccctaggtcaaccctttttggtattttttcattggatatgccatacgatgggatatcttttcggagaatatgagattaaggaaaatatggtcaactaccataaagtgattaatgctgcaatcgcaacgcttgcgacttgcgccatgttgctgccggtagcgggcagcgccaatgctgacgaatcctcgaataccgccgtacttggtgccggctatacggccaccaagatttcgcatcccaaagcagggctgggcgaagacgacggtatcgtaaacgttttgaacggtgaatccattgatgatctcacgcagggtttgcccgagcgtggtcagaactattcatgggcttcggccggctacggcgactggatgtatgtgggcacctgctattccgcaatgggttccacgctgaaatacatggctaacaccatgggcgccaagtatgccagcatcaaggccgctttggatgttgcgttcaacggcgagctgttcctcgacaatggcgagaaccacagcttgctgctcaagatcaacgtcaagaccggtgaagtgaagatcatcgtcaatgcgattggcggagagcatgcggtcaacggctatcgtgcagccgttgaattccatgacaagctgtactttgctgccgccgcaaagggtcagccgtacctgctggaagttgatccgaacagtggtgatgccactgaaatcgtgtatcgttccgctgccatgaccactggtctgaagaagggctacactgctggtatccgtggtttgaccgtggtcaacaatcagcttatcgccagcatgatcaccgataacggtgccactattgtggcttcttccaacccgtcagcaggccaggattctttcgccactatcgctacccagaccgagggcctgtacaactatccggcatgcgctgtaactgatggagtgttcggtggatgtgtgtgggatatggtcggcttcaagggcaatctatatgtcactatggtgactggaaccgcgaagaacaacaagcaatccttcgcactcgtgcgcggcacgcaagataaggaaactggcaagtggaccttcaagccgctggtcggcgatccggcagacggcgccaagtacgagtggggtttcggagcgagtcgttccggcgcagccaacatggtggtatacaagggccacctgtacatcggcggctacaacgatccgatgaacgctttggagaaggccatgcagatggatttctccgacctgtacaaggatctggagagcccggtcaacctgtggcgtatggacgttgacgaagacggcaacgaaaacttcgaaatgctcgccggcgaagccaacaacaagtacttcggcgattccaaaggcaccatcgatggcaataccatgctgtccggcttgggcgacagcgacgagcagagccgtcacctgaaccagtatgtgtggcgtatgcagtcctacaacggcaagctgtacgtcggcaccttcgacatcagtgatcttgcatacccggcaacccagttcgccaacggcgacattctgaagcgtactccggaagagtggaagaagcagatcgaatacatcaagatcttcttcgactctctgaagaagaatgaccagaacggcacttccggtactatcggcacggactctcaggaagcctccaagccttccgagtccgaatctcaggaaaccaccaagccgagcgatgatgacatcatgccgttgaacgaaggcgaagcatctgagagcgatcaagctgcacaggcagttgaagaagccggcaagaccgacgaagtggccgctgacgtggctaccatgcagcagctgctggaggacatgggcgctgatctcaactccaagcagaccgacgtggtctcccctgacggtgtcgctccgcaggccgctgaaacctacacgctcgacgatcgttaccagttcctcgcatccctgcagcggctgctcgacctgtacaacaagaacaagcagtatctgccggaattcattaccaacgagctcgacaagtggcttaccgaagagaatctggagaacttcatcgacttcgtgggcgtgctcagctacctgcattactccaacgatgagactcgtggctttgacctgatcgtctcctccgatggcacgaacttccagaccatcagccgtaacggtttcggagataacaacaaccacggtctacgcgtgttcgccgtcaccgattccggtctggcaattggcaccgcaaacccgtaccatggcactcaggtgtggctgctgaatgatggtgaaatcaagaatgctgagctgacgaatggcgatgcattcgactacgacaagtatgatagcgataagaagagcgccaacgccaacggtctgaccgttggcatcaaccccaatggcaataccgtggaagacgtgcagtacgactaccagtcactgaccgccggcacggattacaccgtggccgatgacggttccatcgtgttgagcagcgcattcctcaatggtcgcgaaaccggcagcaccggttctgtggtggtgttctacaaccagggtgcacgcgtgcgtttcactgtgactatcaaggacagcactccgaacgcaccgaagaaggatgatgacaagcagaatacgaagcctgccgcacacaagaaggcaaacactgccaacaccggttccaacgtaatcggcattgttgtggtggtcgctgttctggttgttgcagcaggggcattgttcgtgttcaagcgcaagcgttcctgaattgccagagcctgttcttagggctcattcctaagttcgtccgcaaataacaatcccgcatgatccggttcgccggaatcatgcgggattttttattttgcagagatcgcctatctcacgtcatgtcaaactgccatcacaagctgatttcaatgtgcgatatgcaaccatgtggaagttccgatacgggacccattgaaaatggcacgcaatcctacaaataacagattcaccgcaagccacagcaatgccatacgcagcgcggaagacgcctgcatcgcatcgcatatccaaccaatcgcagcaagacagggtacatatattgcagctgtcgccgtacacgtcaatgcaagataacggtaatcccctgccccaatcagaatgccatcaacagcccacatccaaccagccaacggcaatgtcacgccaacaaccaccataccgacagtgagcaaatgctggatctcaatcgactgagaaaacagcggggacgcacaccatccggcaatcatcaaaccaataccgattaccgttcctccgcataatcctgccctgccagcgattctcgtcaaacgcatggcttcatcctcttgacgggcaccaatctgcgcggcaaccaacgtctgaccggcaataccaatggcatcaagcatgttcaacacgaaattccaactggaattcaccacctgatacgcagccaacacttccacgcccatatgcgtagccagcaccacattcgccaccaggcatgcacgcaacgcaagcgtgcgcaagaacaacaccgcaccatcgccagcactgttcaacactcctgacaaacgcggccgtaaacgggcaccttccgcacgagtccacaacatcgcaggaacaataagcaacactgccatgaaccattgcgaaatcagcgtggccactccagacccaaacacaccccaaccgaatccgagaataaacagcagatccagcaacgtattgagtatcgcacccagcgtagcagctaccaacgtgatgcgaaccttctgcagtccgcggaaaataccgttggccgcatacaccagcaacatgccgggaataccgaacaccacggcacgcacgtagtcaaccgcgttatgcagcacactcccttgggctcccatggccatgcacaacgggcgtgcaataacgaacagcgccacagataccaccacgccaatgattccagccagccacagaccatcaacgcctgcttccaagccttctcttcgtttgccagcgcccaaaagacgccccacctgcgatgtggtgctatacgcaaggaacacacatagccccactacagtgagcacaatggttgacccgaccgacagaccggcgagcgcctgcccgccaatatgtccgacgatggcggtgtcgatgagcacgaatgctggttcggcgataagttgcccgaacgttggtatggccagtgtgagaatggtgctgatggtggtgcatgatgcgttgtttgcggtatctgtttcgtgagtattctgcgaagttgatgtggtcataatcgtaagcgtctggcgtgttggggactacatgtgcagtgtaaggtcacgtgtttcaccattgccgttgattgctcagattatgactatgcctgttttgcgctgttgagaatgccgttgaaggttttcgctgattgtctgcataaaggtagaggggcatataattcccgaaccgctcgtgacgcatagtccaagctcctgcgagacccattcggccctatccaaaccctagtggattcccgaatccgccttcgcagtaatacttcatgtgaccgtcgaacttatccccgaacgcgtcaatgggctaccgcctggtctcaagcccatgagacactaggaaccatgactacagttatcatgcgcaccactgaaggcgacatcaagatcaacctgttcgatgacaagaccccggaaaccgtggccaacttcctgggcctcgccactggcgagaaggaatgggccgacccgttcaccggtcagccgagccacgaaccgttctacgatggtctgaccttccaccgcatcatcaaggacttcatgatccagggcggctgcccgctgggcaccggcactggcggcccgggctacaacttcgatgatgaaatcgttccaggactgaccttcgatcgcccatacctgctggccatggcaaacgccggcctgcgccgcggcatggacggcaagatccacggcaccaacggctcccagttcttcatcaccaccgtgccaaccgaatggctcaacggccatcacaccattttcggcgaagtcgcggatgacgagtccaaggccgtcgtcgacaagctcgactccgtggcaactgaccgttccgatgctccgctcgagccggtcggcatcacttccatcgaagtgctgaagtaagtttcgcatcaacaagacttacggcaaaacaatgaaaagcccctcgcgtgaggggcttttcattatctccgaaagaatctacagcagttcagatgagtctcacgaccgcactgatcgtgtcatattttgcgtaaacgaggttcggcggagtccttggcaccggtgatacgatacacatcgaacacgccttcaatcttgcgcactgcggcaagcaaagtattcaaatgctgggggtcggccatttcgaagctgaattggctggtggccacacgatcggttcccgtggaaatggagccggaaataatgttcactccatggtcggaaagcacgcgcgtcacgtcgctcagcagatgcgggcgatcgagcgcctccacctgaatcttgaccatgaacacgcccttggtactcgtccactgcacgtcaaccacacgttccggctgacgcttctgcaagtccagcatgttctggcagtccacacgatgcacggacacgccctgattgcgggtgatgaagccgatgatgttgtctcccggcaccggcatgcaacatcgggcgagcttgacccaaatgtctcccacgcccttgacggaaatgcccagcgagctggtggtcttcttggtgcgttccacctgcttgagcggcagagcctcctgctccacctcctcattcacctcgtcgctgcccgcatcacggaccagatgcgagatgacattctgcgtggaaatctgcccttcaccaatcgccacgaacacggcttcggcattggcgagattcagctcatcagcaacaccgaccaacgcctcgggagtcagcagagtcgcaatcggaagattgcgcttgcgcatggctcgtgtcagctcgtcacgaccttcttcgatggcctcggtacgacgctccttgctgaaccattggcgaattttgttgcgtgccttcgggctcttggtaaagctcaaccagtcacgagacggaccagccgattcggacttcgacgtaagcacctcgacggtgtcgccgttttcaagcttggtgtcgagcggtaccagacgtccgttcacgcgggcgcccatggtacggtggccgacttcggtatgcaccgcgtaagcgaaatcgatcggtgtcgcctcggcaggcaacgatacgatcttaccttttggagtgaacacgtagacttcggcagcacccagatcttccttcagggagccaaggaattcattggaatccggggtctcactcgtccagtcggcgagctgctgaatccacttgaaattgtcagcctcgctcagctcctggttctcgccacgtttacgatcggacttatcgggcgagctcagcgcacggccagcttgaccgttctccttgtacttccaatgcgcggcgataccgaattccgcacggcgatgcatgtcccacgtacgaatttgaatctcgacaggcttgccgccaggacccaccaccgtggtatgcaggctctggtacatgttgagctttggcatggcgatgtaatccttgaaacggcccggaacggggttccaacgcgcatgcaccgcacccaacgcggcatagcaatcctgaatcgtgtcgacgatgatgcgcacacccaccaaatcgtagatattcgcaaaatcatgaccacgtacgatcatcttctgataaatcgagaaatagtccttcggacgtcccgttacgtacgccgtaatgttctgttcgtcaagatcttcgttgatctccgcgagaatctgcttcaaatacacgtctcgctggcctgcgcgacgggccaccagcaccacgatctcgttgtagatcttcggatagagcactttgaagctgagctcttccaattcggttttgatcgcgttcatgccgagacgattggcaagtggcgcgtacacgtcaagcgtttcatgcgctttcttctgcgcgctcggagttttgacgtaacgccaggtacgcgcgttgtgtacacggtcggcgagtttgacgaccagcacacgcacgtcgcggctcatcgcgaccaccatcttgcgaatggtttcggcttgcgcggaatcgccgtattccatcttggaaagcttggtgacgccatcgaccaaaccggtcacggtatcgccgaactcggcgcggcactcatcgagcgtatagtcggtgtcctcaaccgtgtcgtgcaacaggccggcggccacaaccaacggtcccatgccgagatcggcaagaatctgcgccacggccaacgggtggatgatgtacggctcgcccgatttgcgccgttgcgaagaatgctgcttgaccgcacgctcataagcgcgctcaagaatgctcatgtcctcatcgggatgatggtattcgcacatcttcaggatcggctcaagcggatcaagcggattcgtgctgatctcgcagcccaacattcgggcagaatgaacctcacgctcaacgtcacccatcgtccacctcctcgctcgcaatgctccctatactacccgcgcctcaccgtgcatccgaggcatccgaccgcgtgttgcacggccaaatacccccgaaaccattgagatgtcagcgtttgccgattcctctgcgactaagccagtgcgttcagctcaggaagccacgcctgtggaaccaaacccacgctcagcgcgatccgacccaggcagcgtttccgcctcgatgaacttcgcttcgacgtaacgctgaataaccagctgcgcgatacggtctcccggatggaacgtcacggtgtgttccggatcaagattgatcagcggcaccttgatctcaccacggtaccccgcgtcgatggttcccggcgcattgagcacagtcacaccctgcttgacggcaagaccggaccgtggatgcaccagagccacgtaacccgctggaagggcgatcgccactcctgtaggcaccagtgcccgctggaacggcttcagcgtgacttcctccgtagtgcgcagatcagcgccagcgtcaccggcatgggcataatacaattccgccggatggtcaggatccagcgactttaccagaacctcgacgttttccggttcgttatatgcttcgtcgaacgccatcaggcagcgcactcctgacacaccggctgaccgtcgtcagtggtgtaggcaagctggctacggtgcttcaccaggaagcattcggagcagatgaactcgtcaccctgcataggaatgacggtcaccgaggcgtcctcattgctgaggtccgcaccgggcagctcgtaatcttcggcgatggcgttctcgtcatcgtccatatcgttggaagtgttctgggagctcttgcccaaagcctggagcgactcctcgtcctcgtctttgttgcgcggggaatcataatcctgtgccatcgagattcctttcgtcatctatggtgcttatgcgccataggatacatgacttttaccccgcataggatacacgaatcgaaatactcgtaaaatccgacacgtggggcacaatggaataaacagaaattcttgaaggaaagtggtgtgttgtgcctgggaattcactcgaggaagcgcggttcgatcatgtcagcgacaccggtgaactcgtctttgtttcaggtgccggaaagttcgctgtaaagatcgacgaagcgcttgaaagagccattttggaggccaagcagattcgttccgaagtacaggaggaacagaagacacgcatcccacccaccctgccgatttcgcaaattcaatcgttgattcgcgctggcgccgatcccgcgcgtgtcgcggaaagatattcgttaagcgaagcgcttgttcggcgtttctcggcttcggtcgaaacggaaaagcaatatgcgatcgagcagtttctcgccgttccagcgccgaaggaaagccgcgtacgcacgctttccgaactgatcgaacgcacttttgcggcagcgcgggtgcgcttggaagatgtgacttggaaggccaccagacttggcttggagccttggaaaatcagcgctcagttcgtctcctccggtcacaatgtctgcgcggaatggtcgtggaacatgcacgacaatgccgtaagctgcctgaattccgcagcacgaaaactcattggagaacaggacacgtcgaaagaaggacacgccgagaaacacgccgatgaaaattttctcgtgtcactgaatcttcccggaaattccgcacggtcggcgcgtatcgagcaaacggtgtccgcatggaacacgcccgagccgtccatgcctgcggcccgtcccgcggcagcgccttccgttccgatcgcgccaatcggcggcgtgtctaatgaatccgacacgcctgacacgccgaacgcgccagccatcgcatccgacttgcctctgccgagccgaccggagaaccctgctgcaggagccaatacagccagcgcaacaaacaccgacacacgcaataccgttccatccacgccggagcctgcttcgaacatggcgaacgagaaccagacacttgacccgcatagccagaacaccaccaaatcgaagcggcgtgccggacgttccgccgtgccaagctgggacgaaatcctgtttggcgactgaagttaggccacgtcgatcaagcagggaatgtcggattcgagcatggtgagcgacccgtgcacgcttggcaggtgcatcgccttttctgcttgcgtacgtgagtccacaatagtgacggctttggcggccgatacgatcacatcgccgatcatcggttcgacgcgagcttccaccggcccatacacgccttcatccattgcctgcgagcgcgtgcgcacctgcgcacggtcctccagcacgctgcgccatcgtgtggcgatgtcttctggattctcgccttgttccgcgtagagcatgacgcaacgcggttcaccgccgacatgggcgacgccctgcatgagccgctgatcctgtgcaatgtcaatcacggattcgggatcagtggtgatcataccgtggtccgccacaatcacaatcaatgtgcctttgggcacgctgcggcggagaaggccgagctgagcgtcaacacgctcgtacgtgccaatccatttgtcggaatcccaaccgtaattgtgcccgaccttatcggtatcacgcagatacaggtacgtcagaccgggcgtttttgccgcttgcgccgcggctgcaatccgttttcgcggatcatcgttggaaatgtagtcgctgccccgtagcgccgcctgcgtcaacgcggaaaaggcgaatttcggcagtccagaactggtcactcgaacatcctgcgcgctcagccgttcgaaaatggtcggttgttgctgcaattcaagcggaggaattgcgtttttgaaggaaatcagctggcatatttcatcggttttcggattgagctgcgtgtagccggtcataccggtcataccggggcatgttcccgtaccgaaggtagacatggctgcgacggtggtgcttggcatgcatgttgcgatgggacgttgattggcggtgtcgttcatcagcgcacgcaagtagggggcatgtcccagcctcatgttgagattccagtagccgagaccgtccacgagcgccacaaccacggaagtcgcatcgggaatgccgagcgctccctgcaaacgcttcggatcaggatggactgccgttggcatggggtatccgatggcgttggaaacagcaggaagtaccgatgacaggtgcaacgctcccccacgggttccttcagatgacacgtcatcgccgtagcatgccggttcggtcatggtgagcagctcttcgacgcttggcacttcaacactcataattcccattcaagcaccgcggcggtaccggctggtagcattgctaggttgattaccattacttttccgtgaggagattcaccgcatggtgtcgcaccgcaaaccggcaaaaccagcctttgacccgcgtacggtcaaagagaacatcgtcgaaacaccgttgaatgaggagatgagcaagtcgttcctcgaatacgcgtattcggtgatctatgcccgcgcgttgcccgatgccagagatggtctgaagccggtgcaacgccgcatcatctatcagatgggccagatgaatctcaatcctgatcgtccgtatatgaaatcggcccgtgtggtcggcgaggttatgggcaagttgcacccgcatggcgactccgccatctatgaggcgatggttcgtcttgcgcagccgtttgcgatgcgattgccgttggtggatggccatggtaacttcggttcccttgacgacggtcctgcggcctcccgttacactgaggcgcgtatggcccaggcagcgcttggcatgaatgccaatatcggtgagaataccgttgatttcacgccgaattacgataacaagctgcaggagccgactgttttgcccgctgcgattccgaatctgctggtcaatggcggttccggtattgccgtcggcatggccacgaatatggcgacgcataatctgggcgaggtggttgccgcggccaagcatttgatgcatcatcctgatgccacgttggaagagcttatgcgctatgttccaggtccggactggccaagtggcggcgtgatcgttgggcgtaacggcattcgtgaggcgtatgagaccggacgtggcgcgttgaccacgcgttcagtgacgcatatcgaaaatgtgacggcccgtaagaaagccatcgtcgtgacggaactgccgttcatggtggggcccgaacgagtgctggaacgtatttccgagggtgtgaagaatcgcaagctggaaggtatttccggggcgatcgacttgacggatcgtcataacggcactcgtcttgtcattgaaatcaaaaccggtttcgatccgaacgccgtgcttgcgcaactgctcaagcacacgccgttgcaagacaatttcactatcaacaatgtggcgttggtcaacggccgcccgcacaccatgggtttgaaggaaatgcttcaggtgtgggtggaccatcgtcgtgtggtgattcgccgtcgtagcgaattccgtaagaagaaggcgttggagcgtctgcatttggtcgaaggccttctgcttgcgatggtcgacattgacgaagtgattcaggtgattcgttcgtctgacgatgctgatgccgcgaagacgaagctgattgccgtattcgatttggatgagattcaggcacagtacattcttgacttgcgtctgcgtcgtctgacgaaaatgagccgcatcgagcttgagtcggaacgtgacgatttgaagcaacgtatcgaagagttggatcgtattctcgcttccgccgaagcgctcgacaatgtggtgatctccgaaatggatgaggccgtcgccacgtatggcacgcctcgtcgaaccgtattgctggatgaggatgccgatggtaagcttgtgcctgttgtggcgcatggtgatgatggcgtgtccgcttcggctatggccgcagcccgtgccgccgcaacggtctcttccgcagcagctgatgttgccgcagccgctaaggcagcgacgaaggccggtgaagacaatgcggccgctgtggcattgcagattgacgacgaaccatgtgcggtgatgctgtcggccacgggtttgatcgcgcgaacctccgaagatgcgttggaacgttgggagaatcgttcttctgccgacaaacgtgtgaaggacgatcagattatttcgattttccctaccaccacacgttcctcatatggtttgatcacatctgccggccgtctgattgtggcgcatgtcgtggagttgccggttgtgtctgcggatggtccgctccatgtgactggcggcgtccatgccgaagagttgatcggtatgacggaaaataccgatccgattcgtggtgaacgcgtgattgctgcgattgccatgccaactgccgatgattccggtgatcatgccgcagaacctgctcctcttgcattgggcacgcgtaatggcgtgatcaagcgttggaatcgtgagtcgcccaccacgatggattcatggagcatcatcgatttgaaggatgacgatgaagtgctggctgccgctgaagcgcgcgatgaggatcgactggtgtttgtttctaccgactcgtctttgctgacgtttgatgcgaagaacgtacgccctcagggccgtaccgcgggcggcatggcaggtatccgcttggctgaaggctgctcggttgccgcgtttgcggtgattcccgccaacaaggtggcttggaattacgaggagggagacaatggcctgttctccgcgtctggagccgtggtgttgacggttgccggcgattccgaagcactgccgggcacggagaatggttcagcgaaggtaaccccgttggagatgtacccgacaaagggtcgcggtaccggtggcgtgcgttcgcagcgtttccttaaggggcaggatacgttgatcctcgccttcgtgggcacatatccggtacatgcttccacggagggcggtgccggtgtggaattgccgaagccggatatgcgtcgtgacggttctggtacggaactttccgcgccaatcgccatcgtcggctgacccattgcaatgtgacgtgcccgcgttttacgaagtttggaatcgtttaggattccgttcgtaggacgcgggcattgttgttcctgcgttttcgtccgcgctgtcactatgcattagcgatgatgatctttttcaacagtaaagtttcatgccttgcggactatcgacgaaacctgcggcgtaaaggatttgccggtattcattgcgtgctttcaataatgttccgttcatttcgctgaagctgatgctgccgctgggttggcgctgcaatacgtaggcaagttcggcgcatgacggtcttaatattgtttcgtctgcggtgaagctgacaattttatggctttttggcacggagaacagtaccggttcgccttgtttgagcacaatgatggaaccggatctgcgtgctggtttgaggtaatcctgttctggccaggcgattgcggaaccagtgagattggcgggatcgatcacgtcgagcgcaacgcaggattgactgtgccattgcgtgtcgctgcgcagcgcgtcgacggtgtctcgttccgcgaattgtgccgcgccaaaacctttcacgaacatgcctcggaccagtgtgccatgttcttccattcgtttgagtaccggatagagcgctgaaaatcctccggcaatccgttccttgtcaaccaaaggagcggcaatcacgccgtatcggtccagtaatgagtcgatgagcgccagctcacgctcctctacacttgccgtatgcgccatgccaatgccggtatcgctgttttcgagcatgcccggctcgataacaccgtctagtggtttgtttggcataacggttcgcccgtcgccacaagatactgcggaccataatccactcagcgccaatggtgttggaggacgcatggtgacgcgtctacgcgcggcacgacggggtgcgcgaacggttttgcctccgtgcagaagcgctcgtactggtgcgaacgaactgttcgtcattttcccctgccataccagtgaccataaggcttcttcgaactgccgctcgccccatgccggaaagatgatttcgcccgtttcggggttcacctgcgcttcggcatgctcaagccagatggtttttgtcacggctgaaagcagttgaataggaaatgctccgccaccgcttaacgccgttaacacggcatccggcatggtcaacgtttcattatcgttcagcttatccaccgccgattcaggctggttgagcagcaaggaacctgctggatagaaggcgatctcaccagcttctttggcgttggatccacttgctttcgaaccgacccacaccacatccgacgatgagatgagttcgtcgagcatactaggctgatagtcacgcacacgtgccgggaataccatggactcccataccgaagcgttcaggaacacgccttccaactgctcgatgacacgcatcagaccatcaacgccttcgtagcgttcacctccaacagggccaacgccctgacgattaagcagaaacgcctgatagacgctcggatcgaccggtttgacggcctttctggccttggcaagagacaatgctcgaatacgccggaaaacatccttgtggagccattgctgaatatcgttcttttcggaagtctcacctgaatcagtgaatcttcccttgatgagttctcctcgggcatccagttcatcaagcgcatgcaccgcctgagccgcgtcaatgcccagttcggcaatcatcttgtcagcggtgaatggtccatgcgttttggcgtatcttgttacgcgcccgctgatatcttcttcagcgagatcattccagaatgttcgcccagcaagctcgccctccacttgtgtaatagcttcggcgtccaacaacgatgccatatccgtgcttcctagaagccgttcgagcacttccagatccatggacagcaactgcgtgcttcgttcggcttggggcacgtcatactggtacatcaccgatccaacgaagccgaacagcatgttctgcgcaaacggagaaggtgtttcagtagttgcctccgataaaagtattgttcccgcatgcaggcctgtcataatcgtgcgtaatgccggcaaatcatatacgtcctgcaggcattcgcgcgcagtttccaacaagagggggaagttcttgcaaatacgagccgcattcaacagttgcgcggccttcaaccgctgctgccagagaggcacacgcttaccgggacgtgtgcgcggcagaaacagtgatctggccgcacattcgcggaatcgagccatgtaaagcacgctttcgccaacttgcgtctcaacagtgcgttgcaattcgtccacgtcgaatagcaacagctcacgtgtaggcaaatcgccgtaaccgtccggcaatcgtaaaacaatgccatcgtcgaccgcgtacacttgaccgtcgaaaccaaaccgctgtttgattcgagtggtgatggctaacgcccaaggctcatgcacgcgcctaccatatggtgaatggatgatgatgcgccaatctccgccttcatcccggcaacgctccaccacgagatcacgatccgaaggaatcgtaccggtcgcttcacattgctcgtcaagcagtttggcaagattgcttatggcattatggtcgagaccatctcgctccaaacgttgcgcggtctcacggttgaactgtgcttccaatacagtctgagccgtattctgatcaccattctttgctggttcacgcctatgcaatccttggctgagctcacgcgtcaaacgcccttgcgccaatccgaaaccataatcacgcccatcctgatccccatgccaaaatggcaagcgcgcggtgcgcccgggagcaggaaccaccactaccctatctcgtgtgatctcctgaatctgccaggtggaagtccccaaagtgatgacatctcccacgcgggattcgtataccatttcctcatcaagctcgcccactcgccgaggacctggaccagagccctcttctggaagcaccaccgcgtacatgccacggtcgggtatggtgccgccactggtcaccgccaagcgttgcgctcctggacgtgcggaaatcagctttgcctcttcgttgtattgcagcggtggacggaatgcggaaaagctctcactgttgtaggcgcccgtcatcatgccgatgacagcgtcgaacatagaccggtcgagattttggaaaggtgcggaacgacgcacaagctcgtaccaatcgttcgtggaaagatcttccatggccgcggctgcgacggtctgctgtgcgagcacgtccagagggttgcggggcatatgcaatggttctataaccccttccctcatgcattccatgctggttgttacgccaataatctgttggcgggttatggggaagaacaacgcgtgcgagactccgccgacattgtggtcggcacggcccactcgctgcaatcccgatgcgatcgacaatggggcggccacctgaaccacgagatccaccgaacccatatcgatgccgagttccaggctggaagtggccaccacgcaacgtaattcgccgcgttttaactgttcttcgatctgtttacgtctatcttttgacacggacccgtgatgagccatggcaatcgcatcaatgtcttcatgcgattcaaccagcatggtggtggatcccaccaccgagtcatagtgcccggcaaattgctcgcggccctccggtgagcccaagtcacggtgctcactcagatcagttgccaccgtgccctgtttcgactccgcatacatgtcgttgagccgtgcggtgagcttctccgccagtccacgcgagttgacaaatatcaatgtggttcggtgccgcaacacctcgtcgagaatggaccgttcaatgaccggccataccgaaccgcctgtagcgctggtgtcgagcatattgcgcaatggttccacggcttttaaatccatggccggaacagcgccggggttcaccaccgttaccggttgcgaaccaccgagaaaccgtgctacttcctcaacgggattaacggttgccgaaagccctatgcgttgcactggatgcccaatcaacttatcaaggcgttcgaggctgacagcgaggtgcgcgccgcgttttgtacctgcgaccgcatgaatctcgtcgacgatcaccgtctccacgctcgtcaatatgctgttcgccttggaggtgagcagcaggaatagtgattccggcgtggtgacgagaatatccggcggatggctgacgattcttcgacgttgttcaggtgtggagtcgccgctgcgcatggccacttcgacatcggggatgggcagctccatcgcctcatactgctgggaaattccctgcaatggcagttcaaggttcttcgccacatcagcgccaagcgccttcagaggcgaaatatatagcactttgacgccacgcttcgttttcttgcgggagcctttccctgcagctttttgttccgcatggctcttggctgccgcgatttcgccatgaacatccactcctgcggaacgcgtcccgcccgccataagccggtcaagagccgaaaggaacgcacaaagggttttacccgaccctgtgggcgccacaacgagcacgttctcgccggaatggatggccggccacacctgctgctggacttcagtgggccgactgaacgcatgtttgaaccatgccttggtcggctctgaaaacaggttcaaacattcgtacatacgttcgatgatcgcattaccgcaagacgttattcatcttcgtcggcaacccattcgagcacatctcccggttgacaacataacgtctcgcatatggtatcaagcgtggaaaaccgtatcgccttggcccgcccgttcttcaacaccgaaacattgaccggcgttatgcctatagcctccgccagctcattgacactcatcttccttttggcgagcatcacatcaaggttcacacgaatggccatatcagatcaccgccgccagttcatcacgctgttcgatggcctgcatcaacagcgagcgcatcaccaccatcaacagttcgaacgccgcgatcagtagaagcgccgccactccgaccgccagcacgacgtatggaaacatttgcccgtcaacccccatcgcagccatcagaaagcgtgaaggcgacaaccagatttgaccgaccatcacggcgagcaccagcatgccttcaatccccgcatatacgagaatgtgattcacccaacgcatggccttgccggaaaagacatcacgtttttcaaccaaggtcagcaatctccacagcggcaccaacgcgaactcgaagcaagcgacaatcagcactgcggcaaccgcatacagccaatgcatcgagtcagcgtcggcatacttggaagcaacgccagcggatgccgcaatcgcactgaactgcagtccgaggcagcatattgcaattatcacaatcagcacacgcaatacgccaatcactatggaacgtttcgctgcggaattcggcatgatatccgtctccttcaatccaataaacctgaatatcgataataatctatcgatattcgatatgcaaatcttgtgaaagtatgttaatcgatatttttctatcgtttttcgatatgtacgatgacgtccaacatatctcagaaaggaatcattatcatgccggaaccagccaacacttccccatcgcagacttcgcaatcccaacaatcatcgccattaccagaagcacaagaaacccaagaaacaccaaaaacacaagggagccagccaacacatgaaccatccgcgcatcaggaggaacaacctttggcgaaacccaaaatcacgcgggaagaaatagcgcaacgccccctcaacaaacgcgcggtcatcaccattggcgctgcatttctcatcactttcgcattcgaccgtctgatctgcagcatacctccgacatggcttatcggatatgaactgccggttttctggatcatctgtgctcttaccgtaaccgcgctgcactggaaaaccgcacgaaaacaagttcttgtttggcttgttttgggaagcatcgtcgccattggcgtgtggaatacactcgctcagtcgacctggtgctattcgagaaatgacgagtacgcgctcaccacgcaattcgttcaaccggcgttgcttatgctgcactgtcagctggtcaacgggcgttacgatgttcgccgtccacttcaggttgcctggaattggcttaccggctggttgcagcagccgtttattcacattcgcgattttgcggaaccgttttccgtcatattcgcaagatttgcagtcgcgtcgaagcaacgttcgaaagtgcgcgaaatcggcattgcgctactgatttccactccattgcttctgacgatcgtaccattgctcatcggagccgatcaaatagttcaatatgaagtgctgaacgttttcagtgatttcaacccgatgacgatcactctgcacatcatgttcatcgtgttgccgtggcctttgctgttctcactgcttattggactcgacgatgaacccacttccacgcctccggagcaacgattctccctcagctcggtaactgcgttcgtggtattggccgtgactttgactgtgtacatgctgttttgcatcgtacagatccggttcctgttcgcaggattgttcaccgatggttcgatcgcactgccagacggattgacctatagcgaatacgcacgcggcggattctttcaactgctggcagtcacggccattaatgtgacgctatttggtttggcgatcgcactcgcgccacgtacgcgcatgctcaacgcggcactggtagcattgctggcgttaaccgccgtcattctagcttcggcggcgcttcggttaggactgtacatcaacgcatacggtttgacttggctgcggtacctttcggcgtcatttatcgccctgcttgcgatcgcgattctgctatgccttattcgcctgaaaatacgacaactgccattggctgcaaccatgaccgcactgcttatcgtatggtacgtggcgctcggcttcagcaacccgaaccatatatgcgaaatctacaatgcggctcatggtatcgcaatggcaatggcgacaacaccgtatcagtcgatggtctgaccagcgcactttttacgcaggctctcgtgcatgatcaccatcagcaccaggaaagccaacatgtacagagggaaccacagcacactgatatgctgtgcgatcaagccgaataccggcggcatgcacatcgagccgacgtatgcgcatgccatttgcatgccgacgatcgcctgcgatttgtcttcgccgaaatatgccggcgtggaatgaatgacgcacgggtagatcggtgcgcagccaagaccgacaatcatcagtcccataatggtgccgatattgcgaggcagcggcagcaacatgatgacgataccggtcagcaccagcgcctgccccaggcgaatcatggccggatcattaaacttcatggtcagaaaaccactcgccaagcgacccacggtgatgccgatgcagaacaggctggcccacatagccgccgtggtcttatcgatgcccttgccaagcgccatgtagctactagcccacagcatggccgtctgctccaatgcgcaatagcagaagaacatcaccaggatttctttggcgccacgaatggcgagcacacctcgcacaccaagcggtttgcgagtttcatcattggccgttccgtcggattcgccggaaacttcgcccgtctttacctcggaacgcttcttccacagtggcagactgaaaataagaatggcggtgagcacaacctgcagtatggagatataacggtagccccacgaccatccttggccggcgcccaaggcgaatcccatgatgtatgggccagtcaacgcgccaatgccccacatggcgtgaagccagctcatgtgacggctctcgtagtggatcgccacatagttgttgagggccgcgtcaacgccgcccgcacccaagccgtacggaatggcaagcagaatcagcacccaatagttaggagcaacggaaaagccgaacaatgccaacgccgtcaacgccacggaaaccgcagtgaccttgcccgcaccaaaacgcaaggtcatacgatcggaaagcaacgcggaaacaatggtgccagcggaaatcgtcatggaaatgccgccagcccacgaaatgggagcacccaaatcgacactcatcgtcggccatgcggcacccagtaccgcatccggcaggccaaggctgatgaacgccacataaatcaccgcaagcaaaagattaaccacgccctactccttcttgatcggtagccgcagaagacaatatccgccattattgtaagcacatatagctaccaatcggtaactacttgattgcactatctaccgtagaatcttcaacctttaccacacggaatcgcataccatcttcactaaaaaataccctccgaaacgtcttgacgtagcggaaggcgagctgacgacaacctcgatcaggtatcgatcttcgaacggtcgaaatcgtcggcattctcaacgatgaacgctttacgcggcggcacgtcatcgcccatcagcagactgaaaatctgactggcctgttcggcgtcttccatacggatacgacgcagcatacgtgtgcgtggatccatagtggtgtcggccagctggtcggcgtccatttcacccagacccttatagcgctgaatgtcctcgttatagctgatgtgcttcttatcaagatcagccaatttgccggccagctcatcgtcggaatacgtgtagatatactcccccttgtgagctccggtcaaggcgatgcggtgcagcggaggcacggccgcatacacgtgaccgtactcgatgagcggccgcatgtaacggtagaacaaggtgagcagcagaatgcggatgtgcgcgccatcgacatctgcatcggtcatcataatgaccttgttgtaacgtgcttgctcgatgtcgaagctcgctccggagccagcgccgaccacctgaatgatcgccgcgcattccttgttcgacagcatctgcgacaacgacgccttctgcacgttgagaattttacctcgaatcggcagcaacgcctggaaaccggaattacgcgcggctttggcggtgccaagtgcggaatcgccctccacgatgaacagttcggccacatcgtcattgcctggctggcaatcagacagtttcggtggcatggatgccgattcgagcgcgttcttgcgtcgcgtcacctctttggtcttacgtgcttggatgcgggcgtgcatttcgccgacgatcttttcaagcacgcggccggactgttccttatagccacgtttggagccggtgatcatctcgccgaactgcctgtcggtcattttgctgacgatcggcttgacctgcgcggtgccgagcacatccttggtctgaccttggaactgtggttcggcgatacgcacagtgacgacggcaaccagacctgccagaatatcgtcacgttcgactttcatgttggaatctttgagattcactttgagcttacgtgcattgtcttcgatggctttgcgaatctgcttggtcaggcccaacagatagccatccacatgggttccaccgcccggggtttccaccacattgacgaagctgcgcatggtggtgtcgtatccgttggtccaccgcatggcgatatcgacggcacaatttctcgtaaccttctgcgcgtgcagttcaccgccatcgccaacggcttgggtttcctcaacataggtgtcttcgccagtgatacgccaaatagcggaaaccgcttcgcctttggacaggtaatccacgaaatccttcacaccgccggtatggcagaattcctcgatacgggagtgggtatacttcgatccctgaggttgtgccgcaacatcggcttcctcgatctgctccgcagcttcctcgtgcccggcagcgtcatgttcagattcatcgctttcggcaatttcctgcggttcatcacctgcagcatttgcaatatcgtcgacttccagcatttcgtcgactgattcatcgccggtttccggaatattctcatcgataacagtgattttcaaacccggcaccaggaagctggtctgcctgacgcgatcaatcagctgctcgtagctgaattccgcggtgtcgttgaaaatctccggatcagcccaataacgaatgcgagttcccgtggtcttcggactgaccttgccaatgatttcaagctcagtcggacggtttttacgcgtgcgtttgaatggcgcatccggagatgggtgctccggatcagcatcggtatacacaccaggatgaccctgatggaatgacatatgatgcgtcttgccgtcacgatccacttccacgtcaagacgggagctcaacgcgttcaccactgacgagcccacgccatgcaaaccgcccgaggctccgtacgaagagttaccgaatttcgcgccggcatgcaatttggtcaacaccacttccacaccggtaagtttggttttcggctcgatgtcaacagggataccgcggccgttatcggccacttccacggaaccgtcgctgtgcaacgtcacaacgatatgattgcagactcccgcaagagcctcatcgacggaattatcgatgatctcccacaggcagtgcatcagaccttggctatcggtggtgccgatatacatgcccgggcgcttgcgcaccgcgtcaagaccttcaagcacggtaagactacctgcgccgtaattgtccttgtctttcgccattttcctcattctgacttgcagttttgcttcggttttcatccataagaacgtcttgtagacgtaagaagtcgagaaattcgatattcttaccgaatttctcgacttcattcacctcttgtttcaatcactgatcaaggaagtcacgcagcgtctgcgagcgagacgggtgacgcaacttcgacatggtcttcgactcgatctggcgaatacgctcacgggtaacgccatacacgcggccaatgtcgtcgagcgtcttgggctggccatcttccaagccataacgcatcttgatcacgccagcctcacgcggagacaacgtttcaagcacctgcctgaactgctcctgcaacagcgagaaggcaaccgcgtcggacggcgcgatggcgtcggtgtcttcgatcagatcgccgaactcggaatcgccatcctcacccaacggcgtatgcaaggaaatcggctcacggccgtacttctgcacttcctgcaccttctcgacaggcatgtcgagctcgcgtgcaagctcatccggcgtgggttcgcggccaagatcctgcagcatctgacgctgcacacgagacagcttgttgatcacttcgaccatgtgcaccggcacgcgaatggtacgcgcctggtcagccatggctcgggtgatggcctgacgaatccaccacgtggcataggtggagaacttaaagcccttcttccagtcgaacttctcgacggcgcgaatcaaaccgaggttgccttcctgaatcaaatccaagaacagcatgccacggccggtgtaacgcttagccaacgaaaccacaagtcgcagattggcttccagcaggtggtccttggcacgtctgccatcgttcgcagcccacttgagctcacgcttgcgcttgaagtccatctggtcggattcggtgtccagcaggtgctgggcatacagaccggcttcgatacgctcggacagatcgacttcctgttccgcattcagcaggctcacacgaccgatctgcttcaggtaatccttgaccggatcagcagtcgcacccgccgcaatcacacgacgcttcggattgccggatggggtcagattctcatcatcatcgtcatcacgcaccacgaaagcgcccttttccttaggctcttccggctttttgcgttcttcctcatcctcgtcgtcatcatcttcaggttcggattcctcgtcgtcgtcgaggtcatcctcgtcatccgaatcgacgtcatcgagatcggcgtcgaaatcgtcaagatcggcgtcgtctacctgagcgtcctcatcgtcaagtgcatcatcctcgagcgactcctccttcttggcaggggcgctcttcttcgcggtagtcttgcgaggggtcttcgttgcggtggttttcttcgccgcactcttcttcgtggaggccttgcgcgtggcggctttcttcgtggaggtggtcttttcggtcagatcagcctgttccatgcttgccgtcgtttccttggtggccaaacttatcctcctattgatcctgcctcgaagcgtataccacatggacccacttctggcaagggcaaatcgtcaactatgtgagtaaaccatcttgcaaggacgattattcccgcataatgaggccttcacgcgcaagtcacgccactttacggcgtgttgccttatgtttccgacgtccaggcaggaccaatacgtcgttcaaccgccgagcatacaatcgccgccagcgaacattgatcatctatcgcgagcgcgctgatggctgatgccatggctccttcccggcccatccaccacatgatgtagctgatcacggcgaacggctgcgcccgatatgtcttcggaatcatatcgataatgtcgaacagcatgttgatcgcctgatcgcaacgtttcatatcgggtctggctaggggatcacggaatgaatcgctgagcagctgttccagacgctgcgcattacgagacagcttgggtctttcggcgaaactcatgagaaagtctcggtcggcgtatcgttcgtcaacgatggcggaaatgagaaatacgtcacgaatggacagcatccgattgatgcccaccgtagtccgcatgatcatattccggtcaagaccgcattcggcatggaattcgccttccgaatgggaaacgctctcgtccgatgcctgcgcaagcgcgtccatccatatgaaaagcggttcacgaatgaacgaacgcactgtttcgcccacgccgtcggatctgcaatccctttcgaatcggctgatggcttcttccatttcagtcccggtgatgcgtccggttttgttggttgtcattattctgccctccttggcatggtctatcggcttcctcgctcgccgcttatatggcactatgcccgatgagccgatgcgatgccgcttttttcgaggcctgtggtcggaggatggcttcttcggcgtttcgcaaaatgatttcggtaccgcaactattgcaatcattgagatttggtcttgtcgaatgcctgtggataactgttggtatgactagctcctccgatttggaacagattgaatcacgcattgtttcgttggtgaaggatttcgcattccttcatgcggacgattcggttgcctcctcttgcaggcctattgccgacatggtcgccaagcaggcggtcacgtcaagtgagggtggcaagcggcttcgcgccttgctgacgttggattcgttccgcgcattcgcttcggaggatgtgcgagaacgtgatttcgacgcgctgcttgatttagcgtgcgcggtggaagtgttccagaccggtgcgctggtgcatgatgacatcatcgatgattccgatctgcgccgtggcaagccgtctgcgcatcgcgcattctccactggtacgcatagcgaggccatcggccatggcttgggcatcatgctcggcgacatgttggccacggcaagcgtggacatcgcggacaaggcagcttccaagctcactcatggttccgatgtggtcgcggcattgctcaacatgcaccgcgaggtcgaagtcggtcaagtactcgatttggccgtagagctcaatccgttggacgatccagacgaactggtggaagcttcattgaacgtattccgctggaaaaccgccagctacaccaccattgccccactggaattcggcatgcttgccgcgggtataggcaaagacgatgcgaggaagcaggcattggcagtcggcttgcctcttggattggccttccagcttgcagacgatcttctggatgttgtcggttcgagcagcaatacgggcaagcccgttggaggagatatccgcgaaggcaagcgcacggtgcttctagccgacgccatcaacacggcgaacgacacgcagcggcgagagctcatcgacatgtgggaggccgattcgcgttccgaaactcaagtaaaacgcgccattgaactatttgagcaaacaggagccatcgaacgttcccgcggtagaatcgcggatttgtggaatgaatcgaaaacagctatcgaaacattgagcctttccgaataccacgagtcactgctcatcgaggcctgctcacgtttcgtgccaagtattcacgtccaaacacgcgcgtgacacgcgacctgcgtgttttccaaccaacatccggacaggacgcgcgttcgttgcacaatccgcaaacctctgcttgtagactacaagtgggaacacgttcgaacgtgagttgttttgaagaaggaaccgtagcgatcaaccatgagtgaagctccacacgcccctgaaggtcaggtcatcgagggccggtatcgggtcgtcagcagaatcgccgatggcggcatggccacggtgtaccaagcggtagacgaacgtctggagcgcacggtcgccatcaaaatcatgcatacccagctggcgcagggaccgcaccgggaccagttcgtggaacgattccatcgtgaagcccgttcggccgcggccattgccaatccgcatatcgtgcaggtgtatgacaccggcgaattcgacggtctcgattatctcgtcatggagtatgttcacggcgtgaacctgcgttacgaaatgaaccagcagggtacgttcagcgttcgagagacgttacgcattattggcgagacattggatggcctcgcttccgcacatcgtgcgggcgtggtgcatcgcgacatcaagccggaaaacatcttgcttaacgaccgtggccatgtgcagatcaccgatttcggcttggctaaaacggtatcgcaggccacactctcctccaccggcatactgctgggaacagcagcatatctagcaccggaaatgattgagaagaatcaagccacacctcagggggatttgtattccgtgggcatcatggcttgggagatgctcgccggcaacgtgccattcacttcagataatccagtaacactggtattcaagcatgttcacgaggatgtgccaagcattgccaccgcttgcaaaggcatcaatgaaggcgtggccgcattccttgcccatctcacggctcgcgcggtcgaggctcgtccagcagacgcatccgttgcgttaaccgagctgcagcgtctgcaatcgacgcttgcggtcagcgattggcagtatcgtcttcccccggtagacgtcagcgcttccgacagtgccgcgcccgcaaataacggtgcgccaaccaatgtcggcaatcctgttcctcccgctcccccggcaccgccgacgcagcaattcgatgatcgcacacgcaagctggacagggtcaagacgaacgcaacaaccgtcatgccggtgcagcaacagaacatcgatccagaagcgacgacacgtttctcgctgccggcagacggcatcgtcaatagccttgacaatgccgtcgacagcgctgcatcgcaatcccccatcgcgcaaagcgacgaatccggcaatactccaaacagcaaatccgcgaaaaagcgtcgcacaccgctcatcgtcgcaggcgtggtggcgctgctgcttgcatgtggcgccggcggttgggcatggtggtactatcagggccccggcagctattggaccatgccccagccggatggtatgacatgcgacgcgtccgcagcatgccccatcaccaatgtgaagtggagcgactacgagagtctgctcaagatttccgatatcgaatatgaggtgtcggaagagtatagcgattccgtggaggaaggcaatatcatctccaccgacccggcgaatgtcggcgatcgcggcagcaagcgtcgtagccagaaagtcaaggtcgtggtctccaagggagtccggcaggcgacggttcccgccgatattctcgacgcgaccagcgcatccggcaaggatccaatcaacgcactgaagaaggctggattcgataatgtcgagcagaccgcggcttctgatgacacgtattccattgacgtgcctcaaggggcgttgctgtcgttaagtgtggatcccggcgccacattgccgcataatacgacgatcaccgtcacggtgtcgcaggggccaaagccagtcactatgcccgatatcgtcggcaagacgaaggacgaggcacagcaggcgctggatgatcttagactcaccaccaattggacggaatccttcgacgacaagattccacaggggcaggtgatttccgcttccgtcaacaacggtgatacgttgcattggggagacagcgtcgacgtagtggtttccaaaggaccggaaaccataaccctgccgaattatgtggggcagaaagcctctgacgccaaagccgcattggaaaaactcggattcacggtcaaggtaagttcgcagctcacgttggattccaatcaagacaagaaggtcgcttcgcaggatccggtaggtggcaccgaagtgcgtcttcgcgacgagaacggcataccaaccaccatcacattgaagatgtattcctcactgttctaaaagtgcattacctgctttgccaaacatcatggtataggcataaggaaagccccggctcgtgtagtgtcgtgccggggcttttctctttggtttctcagctgttcgcctgttcggcggctttctgcgccttaagctgttccttgactttctgagcgtattcgttcacgtattcctgaccgctcatcttctgaatttccatggtcacgcgatcagtcagcgtgcgcaaatcgtcgtgcgtgatctggtcggcgggcttcttctccacggcaatcggtttgccgtagatcactgtggtcttgcccttaccaggaataatctgaccgggcttctgcaactcgcgagatccgataatggcggacggaacgattgggcatccggtttcaaaagcaagtcgcgcagctccggtatgacctttatagaggcgaccgtcagggctacgcgtgccctcaatatgaatgccgaacaggtggccgtcttcgaggatttcacgcgcgtggttcaatgcgccaagcgatttcgacccaccggaacgatccacggggaacacgccaaccgaagtgaaccaccacttcttgaacttgcctttgatgcccttgccttcgaaatactcggctttgcccatgaaatgaatcatgcgcggacaagtcagcggcaacagcgcgtcatcgatgacggcaagatgattggctgcgataatggcaccgccttcgcgcggaatgttttcaagtcccttggcagtcggtcccatgcggtggatggcgatcggtcccaggcctttgacgaaaaaccagtagagcatttttcacgatcctcctagcggatggccatccgcttgattacagttatcagtatgactgacctcaacaatagcaatgccgatgaagaacgcccaaatgccgcgccgaatggtggcgaaggggcttcttcaaatgcggacgatttggatgccgcatgggctgaattcgcaagttcgcatgccgacgatttgcaggccgtggagcattctcgtagcgcgaaacgttttgaaaagcatgcgcagcgccgtgagaaggaggcgttgctttcgattcaggatttggatcagggcacgttcactgatgacactccgcaaggtcgtggaccgcgcgatttcactggttccagctggttggacaccgatagtgtaatggatcgttacggtgatgatttcactcctccgaatccctccatcggtcatgtcaagatatcgaagttggtgttttgggtgcttttgatcgctggtgtcgccggtatcatcgcatctgcattcatgcctgctttggctgggattttgggatcgattttcggtgtgtgcgcgttgattggcgctgctggattgatcgtacagcacaagggacatacacaaacccgccgcgatgttttcgatgatggagctcgcgtatagcaacatatggagaagactgcatcagctacgtcttttgtgctcttctctgtgatatttgtcgctgcgatacgtataaggcgtgtctcgtcgttgagtgttttgacgagacacgccttatacgttcttatgatctgccatttcgccgaatatcaagctttcttggactgggcggcggtgatccactggtcaagcagtgccgaggccttgcctgaatcaacggtttcttcggcaatggcataggccgctttgaatcgttcagtcaggctggcatcagctggcacctgatggccgtccgcaacaatcgcggatgccgcgttgagcagggcggtagtgcggaaaggaacgtccttgcctgcaaggaagtcacggaacagctgagcgttgagctccggctctccaccctttaagtcagccaccgtcaccttgtcgagaccaagctccacagtcggatcgaattcactctcagtgactttgccgttgctgaactcccagatggacaccggaccagtcggagccatttcgtcaagtccctcgcttgacgtgtacaccatgccggtctgtccgttagccgcatataccgcagccatgatcgggctcattgcgcgattggcacagcccaccgccatgtgcttcggcgaggccggattggtcagaggtccaagaacgttgaatacgcatggcatgccgagcgccgcacggacaggtcccacgaagcgcattgccggatggaatgtgcgtgcgaaagcgaatgcgatgccgcattcgttgccgacctcagcaacctgttccggttccagatcgagcggcagtcccagcgcctcgaagcaatcggcagtgccgcacttggaagaggctgcacgattgccgtgcttcacgactttcgctccggctgcggcagccaccaccgcgcccatggaagacagattcaccgtcgcggcaccgtctccaccggtaccgacgatatcggtggtctcaccgtcgatatcaagtttgatggcatgggagaccatggccttggccgctccacgcacctcatccggagtcaagccaagctgctgctgggttgccagaaccgcaccgacggccgccggattagcgttgccgttcatgaggtcatcgacgaaccactcggattcctcggcactcagatggtcccctccgaccagcttggtgaggatcgacttccatgtgatttcagccatgatgccctccttgacgcttcagcatgtcacgttgttgatacgatatcgccgccattgtaaccgttctacatttcatggtttttcaacgtccatatcacgaacaggtaattgcagaaaagcgctcatcataaacaacacagacattttcaatatctatcttccgcatatcgggcaacgagcatgaaacaaaaaggcggtctgcgaaaaatccgcaaaccgccttcattatgcgcgaatcatcagagcatcacacgatatgtcactgttcgttctgtccgtggcacatcttgtacttacgaccggaaccgcacgggcactgggcgttcttgcccgttcccgggaaggtgcggccatccgcccacggagagcgcaattcctcgctcttcgggcgcttattggcaggaaccttgccctcagcatggctgatcggctgcatgcctacgatgccaggctcattcttctgttcttcggccagttcgtcgatgacggtcttctcggcctcatcgtcggtttccggctcggcaggagcggtttcaccggtcggctgcgcttcgctatccaggcccatcaccgcttcggctgcgttcacggcctcttcctcatcggattcggtttcggcgtcttcggtggtggcgacacgatcgatgtcaacgtggaacagcagctggatggtttcctccttgattgcttcaatcatggagttgtacatctgatagccttcgcgctggtattcgaccagcggatcgcgctgacccataccacgcagaccgatgccgtccttgagataatccatctcatacaggtgttcgcgccacttgcggtcaagaaccgcgagcacgacacgacgttccagctgacgcagaccctcttcaccaagcttggcttcgaagtcggcatactggtcctttgcgtcggaaacgataagctcctgcagggctacgatggccttgtctcccttgaacttggagacagcgtccttggcggattccggatcgacggcaatcgggtacacggcgttcagagccttgaacaggccttcccaatcccaatccttcggcttgtcagaacccttgttggcgcccttgatgtagctcaataccgtatcgtcgatgaacttgaggatatcctcgtggatgtcttcgcccttgagcacagcctgacgctcggcgtagatgacggtgcgctgcttgttcatcacgtcatcgtacttgagcacgttcttacggatttcgaagttgcgggattccacggccttctgtgcggtgcgcacgcccttggaaacgctcttcgcttcgatcggctcgccttccggcatgcccttggccataacgcgggccacgagctgggtgttgaacagacgcatcagatcgtcttcgagcgacaggtagaaacgggactcgcccggatcgccctgacgtccggaacggccgcgcagctggttgtcgatacgacgggattcgtgacgctcggtaccaagcacgtacaggccgccgagttcaacgacctcttcatgctcgtccttgacctgctccttgatttcggccaaggtgcccggccaacgcttctcgtactcgtccggagtgtcatccggagaatagccttcggacttgagcttcgcatcggcaaggaactcgacgttgccgccgagcatgatatcggtaccacggcctgccatgttggtagccacggtgacggcgcccttacggcccgcgacggccacgacggcggcttccttgtcatgctgcttcgcgttcagcacctggtggggaatgttggcaacgtcaagcagggacgacacgatttcggaggattccacggaagcggtacccagcagcaccggctggcccttcttgtggcgcttggcaacatcgcgcacgatggcggcaagcttctccttcttggtacggaagatcaaatcgtccttgtcttcgcgaatcatcggcttgttggtcggaatcgggagcacgcccagcttataggtgcccatgaactccgcggcctcggtttctgctgtaccggtcatgcccgacagcttgtcgtacatacggaagtagttctgcagggtgatggtggcgaaggtctggttctcagccttgacttccacgttttccttggcttcgattgcctggtgcagaccttcgttgtaacggcgtcccggcaggatacggccggtgtgttcgtcgacgatgagcacttcaccgccagtcaccacgtagtcgcggtcgcgcaggaacagttccttggccttgatggcgttgttcaggtagccgatcagtgcggtgttgttcggctcgtacaggttgtcgatgccgagataatcctcgatcttgttgatgcctggatcgagaatgccgacgaccttctttttctcgtcgacctcatagtcctcgtcacgggtgagcttgagcaccagacgtgcgaactgacggtaccaacgggtcacgtcgccttcggccggaccggagatgatcaacggggtacgagcctcgtcgatgaggatggagtcgacctcatcgacgatggcgaagtggtggccgcgctgcaccagatcggacttttcccacgccatgttgtcacgcaggtagtcgaagccgaactcgttgttggtgccgtaggtgatgtcggcgttgtactgcttgcggcgctccggcggtttctggttggtgatgatgcagccggtgctcatgccgaggaagcggtagacacgacccatcagctcggcctggtagcttgccaggtagtcgttgacggtgacgacgtgcacgccctggccgtcgagtgcgttcaagtatgccggcagggtcgccacaagggtcttgccttcaccggtcttcatttcggcgatgttgccccagtgcagcgccgcgccacccatgagctgcacgtcgaagtggcgcaggcccaaggtgcgcttggatgcctcgcgcacggtggcgaaggcttccggcatgagcttgtcgagggattcgccattgtcgagacgctgcttgaacttggcggtctggcccttgagctcttcgtcgttgagcgctgcaatctcatcttccagcgcgtcggtcgcctgagctacgtgctcaagcttcttgatctgtcggccttcgcccattcgcagggctttgtcaacgatatctaccacaatcactccctttgtgtatgcgagttatctcatctgagattagtcgctgtttaacgatttccgaaaaacaccgtccattttacgtaactttcagcttgttgcggccttcttccattcgacacaccaccttcagacatgaaaaagaggcccgcacatacactgcgcgagccccgttcggtcagattatctccctatccaacctgttgcacgtcttacttcgccacattctccggggtgtcgatctcgaagacgccatagctccagccgtgacgatggtagacgacggacggacgaccggtctccttgttcacgaacaggaagaagtcatgtccaatcagctccatctcatacagcgcctcatcgatggtcatcggctccgcgatatgcagcttgcgacggatgacaatcggggtgtcgcctacttggacttcgacggactctcccggacccagctcagcggcgacggcttcggccgggctgttattcggcacttcgaccggctcctcaacttctggagtcggctcgacgacaccaagatcgaccgggaccggatcgctgtagccacgacgatgatccttgcgacgatcacgggtgcgacgcagacggagggtcagcttgtcgagcgccatgtccagagcgctgaactcgtcggcgctagaagcctcggcgcgcaccacggtacgacctgcgatgacggtgatttcaacgcgcttggcggtgtcggcttgacgcggattgccctcgtgcgacaacacaatctgaacacgctgcgcatccggggcgatagcggtcacacgattcatcttgctttcgacaacgtcacggaacctttgcttaatctgcgtatgacgtccggtaacgacgatttccatgtggacctccctagactcaagcggtgttacccgctatatacggaccaaacagctgcttcgctgttcggtagtcaacattgtagccgcaacattgtgatttcactgaaaagttgacgcaagaaaaataaagtttttttgattttcctttcgtccgttttcttgctatcatagtgcatttgagacctcttgatggccgcgaccgatccgtcggttgaggaacttccgggctccatagagcacgatggcggataacgtccgcccagggcgacctgagagatagcgcagcagagaacagaccgcttatcggtttcgaccggtaggtaagggtgaaacggcggtgtaagagaccaccgggccactggtaacagtcggccgcatggcaagcctcatcgggagcaaggccaagcagaaggcgtttgagggctgctcgcccgaagccttcgggtaggctgctagagcctgacggcaacgtcaggtcgagatggatggccatccgtgtctgaggcacgacagaacccggggtataagaggtctcactcccttatcacaccgaccggttcccgtggcgaaacagtgtttgaaaaccgcataaccactatgcgaatcagtcgtttcagacgaacaattcctgtgcgattttccgcagaacttcaggattatggcctttccgcccaccagcactccagaaccgtcttttacgcacctcgacatccaatccagcagtttttcttgctgtccgacgtcccagctcccatgcagcctcggcgaacacgccttgggattcggcctcatcgcacacacgttgcgcgagctggcggtccacacctttgcgtttgagctccctgaccgctcccctataccccatcagtcgtgatgtgcagtaccgcaccgcggactgggcgtacgcctcgtcgtcgatgagacggacccgaatcagtctgacgatcacatcgtccaccacctcggaggcataccccttgccgatgagtcgctcccgcatcgcgcctgacggacgcggcgccgcatcaagcagccgaagggccgcctccctgcatgcatccaaatcattcggatcgtcaggaatccgcgacacgccgactgcgacacgccctgcgtgtcgtgcgtgtcgcgcacgcctcggcgtgtcattgccgccaatggacggagttcggtcgtaatcgaattcggttcgaccggcctgcggccgaccaccgcaggaaagggcaaggcccccagcctcggatgataccggccggaggccctgctgttcaagaaatcgctcagcgctgatcatacgtcacgccttgccggctgacttggaaacctttgccgcgcctttggctgcttccggcttgccagcatccgctttcgccttctcctcgcttgtggcattagacgcagaagcctcattaccatcttcggcaaattggtcggtgggctcaatgagaccaaactcggccttcaccttattctcgatctcttcggtaagctccggattgtctttcaagaattggcgcacgttctcacggccttgacccagttggtcgccaccataggtgaaccatgatccggacttcttcacgacattgacctgcaacgccatgtcaagtacggaaccttccttggaaatgccctcgccgtacaacacgtcgaattcagcggtcttgaacggcggagccatcttgttcttgacgaccttgaccttggtgcgattgcctacagcctcatcaccattcttgatggtctggatacgtcgaatatccatgcggacggacgagtagaacttcaacgccttgccgccggtggtcgtttccggattgccgaagaacacaccgatcttctctcgaagctggttgatgaaaatggcggtggtgcccgcctgagccaaagcgccagtcatcttacgcaatgcctggctcatcagtcttgcctgcaaaccgacatgactgtcgcccatttcaccttcgatttcggccttcggcaccagtgcagccactgaatcgatgacgatcacgtcaagcgcaccagaacgaatcagcatatccgcgatttccagcgcctgctcgccgttatcaggttgggaaacaatcaacgaatcagtatcgacgccgagcttgcgcgcatagaccgggtcaagcgcatgttccgcatcgatgaacgcggcgacgccaccgtttttctgggcattggccaccacatgcaacgccagtgtggtcttgccggaggattccggaccataaatctccacgatacggcccttcggtaggccgccgatacccaatgccatatccaatgccagcgatccagtaggaatcacctcgacatcctgctcgggacgatcgcccaatcgcatggccgatcccttgccgaaactcttctcgacctgcgcgagcgccgtatcaagcgcagcctgacgacgcgggtcgatgccgttcgcggacttgttctgtgcggctccctttgccgcgctcgtctgtgccatgactactccttttgctgactatgacgaatggtggcttcaccgtaaggccacggcattcgttcccgcaaatctaacggccgttgtggtcggaggatatgcgatctaacgagtcataaccaacatttcttggaaaatcaacgttttcacgcgatctgaagaatttggaaacagcccgtctaggttgttgtctgtggataactatatcccaacatgcgaacatctgttcgaagaggcgtgttgtgttcggaaaacgtctcagcgcaccggcataggaggcgcgttatggtccttgccccaacgctgggaatcgggaatgcccatctggtcgcataacacattccagaccactcgcggctcctcaccagcgccaagcgcgtccaccgccgtcatgccgccaagacgatcaagcacctggtcatgcgccagcgctcgaccatagctacgaccaagcacctcttcaagtaactgccaaaattcacgttcctgcacgtgccccagtgtacacagacttgaatccatgtacaggcacgaaaaacgcccggcgaacaatcgccgggcgtcaaccttacattcgaatcaggcagccacagaatcgagatagtcagccaccatgcgaagcatctgggctgtggacagccccaaggactgcgcgatggacgacagcagttcggaactggcctccttctggccgcgctccacttcggaaagataccccaaagacaccccggccttttcgctgacctcgcgaagcgtcttatgatctcgcgtgcgcaggtcgcgcagcacatggcctatggcttcacgcagcgaaacctccttagcctcatcgggctgttcctgagcgtgcggcacagcatgcgtgcgcacccgatcggagtcctcttcctgccacattcgcgtcaatgcggcctgacgctcatccttggcctttttcgcagcgcgcgcacgaagcacctgctgctgcgcgaacatcacagcgcgccgctgagccggcgtaagctccctgacacgagctccggcagcctgcgcaatcgcaggagccatagccttgagttccctctgctctttggtgagtgtcatcatttccattcatcagcccctttttcgtgcgtacgtctgtccactatggtcaacactcatctttgtggattattcctgtgaatccgctgaaagctccctcagcttttgcagaatacaatgcacgacgccgcgtcgcacgctctccctatctccctgcaggcgaagctcaaaagcctccgttcgccgagagcgaacacctccgaacccctccggcagggaacaaccgacatatgcaagacctgccggtttatttccatcaggtccaggccccgccactcccgtggtcgacaatccaataacgcagtcgccatccccctgctgccgatacagcctcgccgttccggcagccatctggcgggccacttcaggatggacagccccctcgctgcgcagcagttccgcatctacgccaagaatcgaggccttggcacgaatgtcatacgtcaccgcggaaccgagaaaaaccttcgacgctcccggcacgcgcacgaaagcgtcggccaacaggcctcccgtcaacgattcggcggctgcgatcttgaaatggttggtttcgcaatatgcaagaacggccgcagccaattcatcgcattgcgattggttggcggcagccgtctgatccatagattcagtcatgaatgccttacttggtttcttttccggacttgcccgcggacttcttacggccgccgaacgtattgaccagatactcgccaccggaatacaggcagagaatcagcgcaagataaatcagcgcatacgtgatggtgtagtagacggtcatccacatcggggtgtcgttgaccccttccggcgccaagctccacataggcagcataagcatggccagaccaatgcactggcagagcgtcttgtatttgcctgcctgggatgcggcgatgaccttgccgcccgtgtcgatcacaaagaagcgcatgacggtgatgccgatctcacgaatcaggaacagggcggtcacgacccatcccagcaccggattgccaaattcgttgaagatggcggcaacgatcagtgtgccgcaggtgagcagcttgtcggcgatcgggtccatcagcttgccaagttcagtgacttggttgtatttgcgggccatccagccgtcaagcttatcggtgcatgccgcgatgatgaagatgacagcggcaacccaacgcatggtgacgttgtccacgccccacgcgccggctttggcgtacagcgccaaaaacacgatgaccaaaatgatacgagagaaagtgacaaggttcggcggcgcgttccagccgtcaagcaacgatgatttgcgttcttcttgcttttccataccgttcacgttaccctgacacttctacttgcttaccaatttgcgtttcatacggagcgttccccagtcacatcgccgcttcggaatccgccgccgaagagactcccgaactcagcgacgaggtctcacccttgatgaaggcgagcacctgcggcaagtcctggggctgcaccaacacctcgcgcgccttggacccttcggacggccccacgacgccacgtgactccagcagatccataaggcggccagccttggcgaatccgacacgcagtttgcgctgcaacatggacgtggaaccgaactgcgaggtgacgaccagttccgccgcctgcagaagcacatccatatcgccgccgatgtcttcgtccggctcaatggccttcttgtcggcttccttggccatttcttcgatatcctcacggtaatgtggcttgcgctgggtgcgtacgaattccacggcacgtcggatctccgactcgtcgacccatgcgccctgcacacgcaacggtttggcctgtcccatcggcaggaacagcgcatcgccctgtccaatcagagtttccgcgccagtggagtcgagaatgactcgagaatcagtggccgacgaggtcgcgaacgccaaacgcgaaggaatgttcgccttgatcaggccggtgaccacatcgaccgatggacgctgggtggcgagcaccagatgcacgcctgcagctcgtgccagctgcgtgatgcgttggatggagctttccacatcattcttggccaccatcatcagatcggccatctcgtcgacgaccaccagaatgtacggatatggagcgaccttgcgcttcgatccggcaggggcatgcaccttgccggcgcgcacggcagcattgaagtccttgatatggcggaatccgaagaattcaagatcgctgtaacgagcatccatctccttgaccacccattcgagcgcctgcgcagccttcttcggatcggtgatgatcggcgtgagcagatgtggaatacccgcgtatgccgatagttccactcgcttcggatcgaccatgatcatgcgcacctgatccggcgtcgccctcatgatcacggatgtcagcatggagttgatgaagctggacttaccggaaccggtggcgcctgccaccagaagatgcggcatcttggtgaggtccgccgttacaaaatggccttccacatccttgcccacgcctgtgagcatcggattcggatcgtttctcgccttgtccgaacgaagcacatcgccaagcaccacggtttcacggtcggtgttcggtatttcgatgccgatggcggacttgccttcgatcaccgacaggatgcgcacgtcggaactggccaccgcgtaggcgatgttcttctgcagattggtgaccttctccactttcacacccggaccaagctccacctcatacatggtcacggatgggcctcgcagaaagccgatgactttagcgtcgacattgaactgctggaatgtgaccgtaagagcgcggatcacacgatcgttctccggagtgtgcacggcatgcggcgcgccttgcttcagcatgccgagatcaggcagatgataggggccctccggaatctcaccggactcgtcggaaacgccctctccgttcgatccggcatccagatcgttcacgacctcattggtcgccgcatcgaccatgacctgcgacccgttggacgtgccgtcctcgtcgatgacggcccacgggtcccctacagccacgccaacggatttgatctcgtcggacgccgcctggccggcaaccgtcggaatggtttccgggatctgcggcatggtgccgctcgccaaaccgattgggtcagaggaaagggaacgcaccacaggcgtctgcggcatggcgacggttccaccgaaatcctgagcggaatgttcgtcggatgaaatgctgcgcggccgcgagacgctctggtatggttcgtcaagcatggtttccgccgtttcgccatgccgttcggcagcattacgaaacgcctcatcaccgtcgtaatgatcgagtccgtcctgagcgccctgcttcttggatttcgatgatatccattgctttatgagggagaacggcatcggcttcttcttttcagccgccacatcgtcggctccattatgcgccggcacgccttctgcgaacgacagcgtggtatctcctatacgcacttcgttcgggaattgctcggtctcgtcatcaacctttttatttgcaccgaatccaaaacggaccttcaatgcacgtactttgtcgggaatctcttgaacccctgtattggtaatcagcaacaacgagaacaaaatgacgaccacgaaaataacgatggcgaacgccttggaaagcccccatgccagcgggcagccaagcacatagccgagcagacctcccgcattctgcagcaacgccatgtcgaaaccttgggcgtcggacgcgagcgccgcgtcgagtatggagcagacggaccacagaatcatggaccaccccgccaccatacgcacattgccgcttttgcgcttggtctcatatatgaggctgaatgccaccagcgccaaaaagaccggcaggatgacgctcatcagaccaaacaggccggaagccaaggcgtggagcatccggccgaacacgccctgcacccggaaccattccgaagcgcagaacattaccgcgagaatcaccagaataaaacatgcgatatcacgtccgtacttggtcaagacacccatcacaggcgacggctcgaccgcgtccatgaccttggtctcgccggaacgtgccttgcccgtggaccctttgccgccggatttcgtattggaagatgctgttcgtgccataacggtcatgattttacccatgggatgcgccatgacatggcacttcctcgaatcgcacacattttctaacttaagtgaacacgcaatttcactgattggattccgccaagatcgtcaccgtcaagttgggtgccaagccggagaagaccgtggataaggtggaaagcttcgacgaatacggcagcgggagtttcatttcaggcgaggtctccgagatgatgctgggtgtaggcgtccgcctgcgcgtctatggcgtcataggcacctgcatcggcatgttcgatgatggccatcgcattgtctagcagcgccggattgagcgcttggagccagtggatgcgcgggtcacgaccgaaccatcccatctgcttgcgtgccagacgcttcgttttctgcgcaatgtccatgaacgtgtcgttcaggtcacgcaacccgtccaaatagtcgacgacctgctggtaaccgagcgctttggctgcggtgatgcccagcttgggacggatacgttccacttcttcgatgaatccgccttcgagcatctgcttggtgcgaatatcgatacgacggtccagttcctcacgcggcagatcgagaccgatttgcacggtggggatgacgtaccggtagtgcggaaggcttgccgaatagggtcgtcccgtcacttcgatgacttccagcgcacggatggtacgccttggattgtgcgggtccatgcgcgccgccgcttcgggatccttggctttcagctcgtcgaacagcgcgcccgcaccttcggttttttcccgttcctcaagcgccatacgtatttgcggatcggtgccggggaaggagatgtcgtcgatggcggcccgtgcgtacaggccagagcctccgacgaggatcggacgcactcccctggcctgtagttcggctattttctcgcgggcgagctcttggaacctcgccacggacatggcgtcgtccggttcgatgatatcgatgagatgatgcctgacctgcgcctgctcctcaaggcttgccttggccgtgccgatatccatgccccgatacatctggtatgcgtcggcgttgatgatttccgcctgttcgcctttgcgcgccaacgctttggcgacggcaatgcccaacccggttttgccggatgcggttggtccgacaatggatacgaccttgcgctgcatcgcaggatcggcgtctcctgttttgtctgttttctcaaaggtctgttcagtgtcgaacggcataggtctgccccgccttcggatcgggatcggcgatgaggttgtgacgcccagcgtgggtgatggtggcggtcacgaaatcgcctacctgcggcatcggctcgccttcgggcacaccgacatgcacgagcacgccggttttctcgcgcccggtgacacgatgggtcgcggcgtccttcttgccagatgcgccggtgaccatcacttcgacgtcacggccttcgaaggttttgagattttcttcggtgatgcgttcctgcaatgccacgagtcgttcgaaccggtcttggaccacgtcgtgcggcacctgctccatttcggctgccggagtgcctgggcgcggcgaatagatgaaggtgaatgcggacgcgaatctcgcctcttccaccacacgcaaggttttctggaagtcctcttcggtttcacccgggaaaccgacgatgatgtcggtggagatctgcgcatccggcatggcctcacggattttacgcagaatgtcaaggaacttcgcggaacgatacgaacggcgcatggcgcgcaggattcggtcggatccggactgcagcgggaagtgcagctggtgcatgacattgggcgtttcggccatggctgcgatcacgtcgtcggtgaaggcggcgggatgcggcgaagtgaaccgcacgcgctccaatccttcgatctcaccgcatgcgcgcagtagcttggagaaggcgaaacggtcgccgatgccgtaaccgaacgagttcacgttctggccgagtagcgtgacttccttggcgccttcgtccacgcactggcggatttcggcaagaatgtctcccgggcgacgatcatgttccttgcctcgggtggtaggcacgatgcagaacgtgcaggtgttgttgcatcccacggagatggccacccagcttgacaccttcgacgcgcggtcggtgggcagctggcttggaaagtagttgagttcctctttgaccttgacctgcgcatggccttcgatgcgcgcctggtcaagcagctgaggcagggaaccaatgttcttggtaccgaacacggcatcgacccaaggggccttttttgcgatcttctcacggtcgagctgtgccatgcatccgccgactgcgatctgcaggttcggacgctggcgcttcagttcggcccacaggccgatggtgccgtacatgcgttccgccgcgttttcccgcaccgcgcatgtgttcatgacgatgaggtccacgtcatgatcgaggtattgttcttcggtggcgggcacatagccatccgcttcgagcacacccgcgatgcgttcggaatcgtgcacgttcatctggcatccgagggtgtgtacgtagaacacgcccttgcctcgcgtggcggtgtcttctgtggcaggttccgcaagtttcgaggcgcgctccgcctcggtcatcatgtcttcgttcatagcattccatgctatcggcagggattcccatcacgcgccgtatgcaccttaatgcagcgtggcatgcggtggaattggagggatgacggcgctttcagcgctttttcagtttttccgcgctccttttgggtacactatggaaccgtgatacttgatagacagagccgcatcaataccagtgaactgcaagcacggctgaagtcggtgactttcgacgatggtccgttgccttccgatcagattaccgagttcattgatcaaatgcaggtgtatgagggcgcgatgtatgagatcagcaccaaactggagattctcgattccgagttccaggtgcgtttctcccataatcccatccatcacatggaacgcaggttgaagtccatcaattccattctcggcaagttgaggcgcaaggatctgccgttgacggtggagtcggtcaaggacaatctgtttgacgtggcaggcattcgcgtgatctgcaattatcgcgatgacgtgtattcggtgtcgaattatctgtccgcgcagaacgatattcaggtgttgcgtgtgaaggattatattaagaatccgaagcagaatggatatcgttcgctgcatgtgatttatgcggttcccgtttttctatcttccggaccgcattacacgcctgtggaggtgcagttccgcaccatcgccatggattattgggcgagtttggagcatgcgctgcgttataagacggatttgcctgacgcgaagctgtcggagcattcgcagacgttgcttgattgcgcgagaagtctgcagaatgtcgaagcgcagatgcagaacattcatcgcgatatcaatggcgcgccgcaggttggcgaggcccctaaggccggctgacgtctgccggtttgcgtttggccgcatgcaggagctggtcgatgggcagctgggcgagtatggtgcccgcgaaaatgagcgtgcagccgaggtaggctcgagtggtcatgatttcgcccagcagaagcgcccctccgactgcggagaagaacgattcgagcgacatgatcacggacgctctggtcggaggcacaagttgttggcctatgacctgaagcgtataggctacgccagcggagcagacgcccgcgtagacgatggcgatccagctttgcgcggcaccggcccagtcgatggatccttcgatgatagagccaatccagctgatgatcgcggtggtggtgatctgcccgaatgaaagcaggatggggtccatgtctcgtccaaaggtgtctatgacgaggatgtgcccggcgaagaggactgcggtgaacagcagcaccatgtccgccagggtgatggatccgaatccgtcggtgacgcacagcaggtagaagccgataacggagatggcgacgctgatgatgacgctgaggtgcactcgtcgacgcaatatgatgaaggccagcagtggcgtcatgacgatgtatagagcggtgatgaagccggaccgtcccgccgatccggagtaaaggatgccgtattgttggacggtgcttgcggtgaaaagcacgattccgcagatgatgctgaccacgatgggattgccggcccatttcggcatggcgacgattgcgccgttaccgagggtgatggacggttttccctgggtttcacggcgtttacgctcttgttccgctatggtgctgcggcgaaaccaaagcaacggtatcagagaaatggatccgagggtgaatcgggtggctccgaagaacagcggtgttgtggagtccatgccttgcacttgcgacacgaatgcgaatccccaaatgagggccgccagtacgaggcatgccatgccgccaatctcttttctctgcatgagcacccaccgtaaagcatgtctttgaccaacggataaagcctggccacattctggtcaggctttatccgttacgttgaccgaggagcaatgccaataatgtcccatcaaaggctgaaagccaaatgacgcgtgcgtccccaaaacgcaccgaaggaaggcgcacgaaggtacgccgactgaggagcaatgccggggacgctccgtcatttggatttcagtcgcgattgccgaggagttggagaatatacatgaacatgttcacgaaatccaaatacagattcagtgcgcaaaggatggaaaccttcttgaccatttcggggccttgggcggaatactgttcaagcatggcgcgggtggcttgggcgtcgtagacggtcatgccggcgaagagcagaagtccgatggcagagacgatcatgagggtggtgttgccgggggcgaagatcatgagaatcacttcggcgatgataagcacgatgaggccgacgaaaaggatggggccggccttgagcatgttgatcttggtggtgcgtccgaacatggtgagcgcgaagaagaagccggcgcacaatgcgagggaaatgccgatggtgccaagatcgtaggccatgaagatggtgctgagggtgaagcccatgagcgccgcatacacgtagaacatgacgtatgcggtggagaccttcattgtatggatgcgcgcgccaaggtagatggcaagcacgatttcaatgacggcaggggcgaagatgccgatgatgcccgtggtttggatgagtgccaggtacgcgccgctcatttgggtgatgatggcgaccacggcagtgacgatcaaaccaagggtcatgtgcgtgtatgcgctgttgacggaactgcgttcggcctgctcgtaggaataggtggcctgcacgttgactgcggcggtaccgttgggcgcataggcgtactgtggctgcgcattgtactggttgtactgttggttgtactggtattgattgttgaagccgttattctgggcgttgttaccctggggctgctgaccgaatgccataatcgctcctttttgctcgattgcgcatcacgatacggcattttcctgacgatttcatgaatattggcttaatctcatgatttcttcaaagcccgcataggtttcgcgttcgacacggggagtgtgccggacgcgaaagactgggacatgccatgtcagatggcgaacttgtacgtcactttggcggtgtcgctgaaatcgagaaggttcgtcacgtcgacggtgatttcggaatcgtctttaagcacatatccgagggttaccgtgccggttgctcctggctgcagttcagacagataggagccggaatcgtagccttccggattgtccaagtacatggcggtgtcgagttcctgaccgttttggaacactttcggattagccagcacggcgaaggagttgttcttatcggtattgttggtccactcgtaggtgacgagcacggtcggctgattgttgtagtcgttgccggaacgcactgcggatacgattttgacgtgcatatcggtgagatcgccttccatgtcttgctcgcctttcaccttagtgtcggttttggtggaatcatcggttttggtggaatcatcggttttggcgtccttatcggcgtccgccgacgaggattgcgacgtgcttgtgcccgtgatgtcgtcaagcgccttgctggcggccgattgcatggccaaggtgatgacgatggccaacaccgacagcaccgccgcgactatggacagggctttgccacgctttttgcctcggaacgtgcccacgatggccacgatcgccaataccgcgccgacgagtccgaagatcgccgcgatgttgttgatgattggaatgaagctcagcaccaagccgagcgcgccgaacaccactcccacgatgccacataccgtcgtgccttgcggagccggggacggcatgatcggcgcgggtctcataccgttcggcgctgccgggccgccgttgggaatcggagcattgttgaactcactcatgatctttttctttcttctcgaagtggtcggaacactttcgagcctacgggatcggcttcgttcccggtattggacgaaagtccattcctgcctgcactttggggcgcgcggcttgcgccatcatgcccgatagctcaatggcatgtttccatgagtatgccgataatgggagtcatgagcgtgatcacaaacccttccaccgccgaagtgccagtgcgcaccagaatctggtgcacggtgccgatggtggtgtgcgcgagtttcgcctgtctggcgcaggtgtctttcgcatcccaacagtatgcgcaggatagtgccccctacttgtggatgatcgcgtgcgtgctcgttgcgatcccttcgggtttgattcttctggctcgcaacagttacccgcaagccgtgttctggaccgcatgcctactggtggtggcgctcccctacgattcgctgatcgcgcttatggcgttgacttctctgcttgcgcggagacagggaaccaaagtgacgcttcgatcagtgcttgccgcggcgacaacgacgatctggtcccaggtgcgagacgctttgcatcctgccgaggcttcgatctggcatgcgatcttctccaaaccatataccggagttcggtatggcaataccatggtgatgcttgtcgacgaaagaacgatcatcgcgagcgccgttgtggttgccctgattgcggtggcgatcgccacattggccggattgcatattcgctcgcgcgcccttgcgcgcgtggccgaagcgaaggctcagtcggccaacgagcaggtgagcaggttgcggaccacgcttgacaatcagcagcttgccgatgcgatagccgcggaagcgcatgatacgttggctcattcgctgtcgttgcttgcattgaatgcgagcgctttgcaggccgagtctaggaaattgaaggctgaggccgagcagttgggcaatgccaatgtggctggtatggctggaaagatcgccggcactaccgaggatattcgcaggcaggcctccggcgcgttggatgaggcgcatagtgtgattgacatgcttcgtcatccggaggatgctcgcctgcagttggctgcgaatgatgccgaagcgtcgttgacccgtgactcattgctgcagttgattggcgacgcccgtgccgcgaatatgcggattgatacgtggatcgacgttcaacagctggggcagttagatgagtccatcggcgtgattgcgtatcacgtggtacaggagggattgaccaatgtgcgcaggcatgcgcctggcgttccggtgtcgttgcaggtcgatgcgaaccccccgcaaggggtgcatgtgcacgtcagcaatccgacgatgccgcaatccccctcgcatatggcagacaccaggaagggggccggtcttcctggtttggccaaacgcatacagcaggctggcggaacatgccaatacggttttgaccaacataacgtcttccaccttgatgtacgactaccatgggttgggtgagcaccgaacgcaaccatgacgagcagccgatcaccgtcggcgtgattgatgatgatccgatgatctgccagatgatgcgtctgattttggaggattattcctccggacgcatcagcgttgccttcgcctgcaccaacgcagcagacgccatcgaacatgcgtcgcacaatcctcctgatgtcgtgctggctgatatcgccatgcccggcatggatggcattgaagccactcgtcagctccgcatgcttcccgatcctccgcatgtgcttattctgacgtcgctgagtccaaacaacacggtggaacgcgccatcgaagcgggcgcggaaggattcgtatcgaaaacggacgctccggaagatatcatccgccgtgtggccgacgtgtgcgaaggggagccacagttcaatccggcaagtcaacggcagctcatcggcgatttgcatcagcaccagcctcagtcgcggcgcgatgaggcccgtgccatgctcgacgccttgccggaacgcgaacgcgaagcggtgattctcgcggccgagggcttcaccaatgcggaaatcagcgagaaaatgttcatttcagaacgcacggtcaaagcgcatatttcatccgccgcagataaactctgcatgggccgcgtgcagatggcccgtttggtagaacgagccgacctgccgccacgactatgacatcatacactcgtacacttgaacacagagcaacgcaatgaggggaacgccatgtcaatcagtgcaacggaaaagcctttaggcaaaatcttcacttcggattaccggttcgtaatcccatcattccaacgcgcatatacttggcaaacggaaaacatcgcgcaactggtcaccgatctgcaggacgcatgccacgacccagacacgccgtatttccttggatcgctgatcctcgtccatgatggacaaaccaaataccaagtcatcgatggacagcaacgcctcatctcactttccatcatcatttccgtgctccgcgatctggaagacgaccccgaactcgtggaaagcctcaacgacctcatcgtcgagccaggagacaaactacgcggcatcaaagccgaaccacgtctcaaactccgcgaacgcgacaccaacttcttccgcatgtacgtgcaggaaggcgatctggagggactgttcgatctgcgcgacaacgatatcgaatcgcacgcgcgacgcaacatcgccatcaacaccagacaagtgttcgacgaactcgcgaaaatgcccacacaagaccgccgcgcattcgcatcatacctcgtcaacgaagtcaccctcgtcatcgtaaccaccgacgatctcgccggcgcacaccgtattttcgacgtcatgaacatgcgcggagttcccctcaccgcatccgacgtgttcaaagcaagaaccatcgccgaaatctcccccgccgcacgcaacgcctacgcttcacgctgggacgacatcatggatccactcggcgacgacgcacagacgctcgaagaattcttcagcgacatccatctcatcatctcgcacaaagccgtctgcacacaactacttgaggaattccgcaaggacgtgctcaaaccattcgtcaaaaagcagaacgtcatctccttcatcgacgacctgctcgcaccctacgccaacgcatggcgcatcatcgaacacccgaccgacgccaacctgccagacgatatcattggccaactcgtatccctcaacgactaccaaaccaccgactggaaaccagtagccatgtgggcgctcgtcaactccatacgcaacctcggcaatcccgacacacgcatattctccacgccgggcacacacactgccgcagcctcgcgcacgtcgaacaaaaacctcgaggaacttcaactccacgaccttgaacgacttcacgacgtactcgcggccctagaacgcgtaaccggcgtggacagtctcaacaggcaaaccccgctcaaccgacgcacacgcgcagccagcaccattcgcgacctcgataaaaaccacaccatccaacaaatccgaggattactcatcaccgacgaagaccgccgcaacgcgctcgcgcatctgcgtggcgacctgcagaccagtcccgccatgaagaaactgcttctggttcgggccaacgagcagcgggccgggcatcgtatcacccgaccacgcagcctcaacgcgctgccgatcatgccggaacaggtcgcctccgactcatcgtttgcatcatggtctgaggcgacacgcgaccattgggtcaaccgcatcggcaatcttgcgctcagtcaggctaatgacaagcagatcgcgggattggcatcctatacggaccgtcgtgaccgtatgctgctgtcggcgagttccaaacgcttcccgctcaccgccgagcttgccgacattgcggactgtacgccacaaaccttgcaataccgccaggatgaaaccattcgtctgatcgccgattattggaatatccgttacgatgccgagcgcaatgacctatccacgctcagtgaggagtcgttgcgagtcacggacacgtccacctccccaacatccaaacgcgtgtccatcgcgcaggtgctcgccgctggtctgctcattcccggtgagacgctggtatgggaccgaccacgcaagggcgaacgttgggtggctaccgtcaccgccgaaggcaagcttcgactggatgacggcagcgagtactccacaccaaccgcagcggcccgtgccgtcggtggcggttcggcgggattgaccgtgtggaagcgcacgtcgaacggtcagaagcttagcgacgtgtggaaggcctatcgcctacgcaagcgctgaaaacgctgttcgttttgatgagtttgccgtttatcgacggtttcctattggcatgcgagccattcgaccgcaagtttcgtacgattcgtaacgttcgttttcgcgagaatatcgctgatacgattgcgaaccgtgccttcgcttaaaaacagtttcgcagcgatctcacgattgtcgtacccctcggcaaccagttgcatcacgtcccgctcgcgctcagtgagattcgcgaaacgaccggaaaaacgattttccccgttatcgccagcttgcgaaacgtgacgctgcgtctgactcgctttattgacatgcagtttccgcaacacctgcgctcccataaccacctgtccggccatcaccgactgcactgcgggaatcaccgatgagacatcctgtttgatcagatagcctttggtgccgatttccaacgcctcggcgatgtacgattcgtccgcgaatgtggtaagtatcaggattttcgcattcggatgggcgtcgatgatctttcgcgacgcggcaagaccgtccataaccggcatttgcacgtcgatcagcagcacgtccggattgtcttcttcatactgacctaccgcggtttcgccatcataggccgtccatgcaatatcggccgtgcctgtcgctttgagaatcgtggacagcgacgagcatacgattggatcatcatcgacgattgcgactcgcatcatacgttctccttcgttgttgcggacgctgccgcatcatcgtccgttttgggaatggacacgaacacccgccacccctcatgatacgggccgcacaccgcggtaccgccgagcgcccgcgcacgctcctcgatatccgccaatccaatgcctgaagcatcacgcatcgtcgccgtacgcgcggcatcatggaactgacgaaaacgagcggaagactcccccatcataccgttgatgtttccttgggagccatcgttccacagggcgccatcatcctgtatgcgcagctgccataacgcaggaaaatcacgcaaggtgatatcgacattgcgcgccatgctatggcgaatcgtattgttcaacgcctcgcgaatcgtcgtggcgaaacagcgtgacaccgcggccggagccgcatcgatgccgttgctcaaggtgacgttcactgtactggaattgtccaaaccatgcgcggatgcctcaatctgcgccacgaaatccgtgccttcgtctttcagatcatgcaccgcgccccgcaccaatgtcatcgcctcgcccaccgtgtcgtgaatctgcgcgaacccttgagccgcctgctcctgaccagaaacctgagccaccacttgggccgcttcggactgcatgatggcccgggtaagcatatggccgacattgtcatgaatctcgcgcgctatgcgtgtacgctccgcgagcgtggccacacgaaccgacgcggcgcgatcttcctcgctttccgccaattgcgagcgcagccggcggatctggtcacgtttggaatcctgaagccgcctgttctgccgggtgagcgtgacattgcgcgcgcacaacaggccaaccatgaatcccaacactacatgcaatgccagcagtacggcgatgagtgcagctcccatatcatccgcatgcgcgcctgcattacggcaacggaccaaggtcgccactacgggaatgatccacacccatcgtgcgatgaccgtcgtgatttgcatcgcatcgtattgcggcatgttcggcaattgcgaacgcaagccggcatggttccgtcccgcacggtgttgttcgacgttctgtgatatggcgggcagcatggccgcgttgtatgcggcgaccggcatcatcgcgcaccatgatggcgtgaagcatgcgccgcaatccaacatcaacagtatggcgatggtccatgccgacgagcgcgcgtattcccccaccgcggcacagcatatggccagcaacgcgccgcataccagttcagccgatacgtctccgacgatatacaggtttgcgatcagcccgaacgtgaggaatatggcttgaagcaataatcgccgcatgccttcctccatcgtcgccgcttcttgtggttatgtcttcccagcgtagtgtacgttgccgccgttgcgggccatctttgccacgaaggtgacatttgtcatcttccatatggctgtgttgcgccaggtttatgacctcagacaccatgtcgtctccgtttggtcggagacaatggaatcactatcgtaaacggcggttatcgctgttggaacatgtgaggtaaggagagccgatgagcgagcgtatggaaaggcaaacaggtgagagctccagcagcgcggtcaaggtgtcgaagctggtcaaacggtatggggatatgctggcgcttgactatttcgatcttgacgtgcatcaaggtgagattttcggtttgcttggaccgaacggttccggcaagaccacggcgattaactgcattctcgcattgttgacgttcgatgagggcacggtacgtgtgtttgacgaaccgattggcccgaccagttatgcgctgaaacgccgcatcggcatcgtaccgcagaatgtggctgtgttcaatgaattgacggttgaggagaatatcgattatttctgctcgctgtatgtgcctgacagggcacgccgtcatgcgctggttgaggatgcgctggattttgtgggcttgcgcgattaccgcaggttccgtccgtcgaaattgtcgggaggtttgcttcgtcgattgaacatcgcatgcggtgtggcgcataagccggatctgattttcttcgatgagccgaccgtcgccgtcgatccgcaaagccgcaatgcgattctggagggcattcagcgtcttaaccacgaaggcgcgacggtgatttacacgagccattacatggaggaggtcgagcagatctgcgaccgcattctcatcatggatcatggcaggcatttggccttgggcaccgccgacgagttgaaggcgatgatcgacaccggcgaacgcatcagtgtggaaaccgacgatctgggtggcttgcatcatgaggcgggaacgcagcaggcattggaacagttacgtgcgctgccatgtgtgatgagcgccgattatgacggtcatgagttgacggtacgttgccgtaggggcgatcacaatcttcttgacgtgttgacgttgctgaaatccaatggcacgaatatcgggcatctttcctcccggcagccgacgctgaacgatgtgttccttgaactgaccggcacggcgttgcgtgactgacggaatcatggttcgaaaggtttgacattatgttgcagacattgctggtcaatctgaaattgcatttcagggagaaagcgcagctgttctggctgtttgcctttcccatcattctggcgaccatgttcaatggcatgttcggcaatatcgcggaaagttacgcattgcacacggttgacgtcgtcgtggttaataacgacgattggcgcgcctctccgggcgcgcagatgctggtcgacggcatttcgtccgatactggcgcgaccggtgccgatggcgatcatgcgaaggtcgatgatgacggtgacgccatgccgaaactcatcaccgtcacggaagccgcatctatggaagccgcggatcgagcgctgcttgacgccaaggcgcagggcagactgtccgtcgacggtagtgggaaactgcagctggccatttcccaagccacgcaaacatccgccacggatgtgatggcgtcgagcagtggtctggatatttccctgacggtgttgggcaatatcgtggacttgtacaatcgcaacaccgccgtagtgatcaatgccgcgcagcacaatccgtccgcgttgttggatgacgcgttcaccggcagcatcggctcgtcgagtgggttcacgaaggaagtgcagctgacgaatttcaagccaagcggcaccgcacgctactattacgcgttgctcggcatggccgcgatgatggccatgagtttcgcggtgaacgcggtatcgttggcccaggcaaacctgtcggcacttggcattcgccgttccgtcgctcccctgccgaaactgcaacagctgctggcaggttttctttccagttggatctgctcgttcctaagtctgaccgtggccatgctgtacattcgtttcggctgccagatttctctcggcggtcgtgaatgggccggcttgggcgcgtgcttgatggcgtcattcgccacaagcgcgttcggcacgttgatcggcgcaatacagggtgtttccacgagtgccaagcagggattgtgcacggccttggcatgcacgctgtcgctgttttccggtttgtatggctcgttcgccatggatttaagcgatcagatagcgcagcatgcgcccctgttgagcatgttgaatccggcgcaacagattacgaatctgttctacgacattctgtattacgacagtttccgcccgttctttgccacggtgggcgtattggctgcgatgagcttggtctgtcttggtatggcgaccgttctgttgaggaggcaacgctatgaacacttgtaaagcagcactgcgcattctcaaagcgcgcaaattgtatgtgattatctacttggtgctgatcggcacgatgatgttttccatcagctggcagatcatgcgtggctccacagctgccggagcgacgacgtatgagccggaatccgcccgtattgcggtaatcgaccgtgatgacgacgccgagcatgtggctcaatcgttgcgttcctacctcgctttggacggtgagatggtcaccattgatgacgattccatatcgttgcagcaggctgtcgcatcgaattatgttgatttgattgcgattgtgccacaaggtttcgccgagcgttatctgcagtatgcggataacgccacggctacgcaaccgaccatagataccgttgtcagttatgcttccggagccggatcgctcgcacagctgaaagtcaacgagtttctttcgctgacgcgtaccgcctatctcggcatgccgcaggcacagcgcacgctcgacgccgccatggcaacgacgttggatgctgccaccgccgatatgaaacagtcgcatatcgccgtggtgtcctcggactctgaagatgacggcaccacaccgggctcatcggcattcgcgggcacgctcaaaaccggcttgtatccactgttgctggtcatgccggtatgcacgttcctcgtggtcagcacattcaacgacaacgaaatccgccgcaggctctactcgtcccccgcgcgtctggtgtcgttggaagcgcagcaaatgctgacatgcgggacgttcggtctgctggtatgtgctgcgtataccgcggtgacattcctgttgatggcgctggccggagtgtcctttaccggcctgaatgccgtgaacgtaggcttgtcgttcgtgtcgctgatggtctacacgcttatggcgatcgcttgcggattcctgttggggtcatccggtttcaatgaaatggcaacgaacggtttcgtcaatgtgttcgctctgctggtcatgttcacttccggtatggcgttccccgtggatatgatgccagatcccatgatcatcatcggaaaactgctgcctggatggtggctctgctcatcgatagaccacgtattcggactgggtacggcctcctcgagcggcgtggactacggcgcgtgggcgtcatcaaccggattggtggcaatgttcgcggtagcgttcatctgtctgggcttggccttgggacgcattcggcgagcccgcccgacgttggcctcccccgccacaacgcagttggccaagtagtcgacgccaacactgtggcagccgcatgacgatcgcatacgacgtccacggtctacttgagcatattcctccggtaggctgtgggcgtcgtatgcatgtactgcttgaacgtgcgcgtgaagaatgtcgatgatgagaaaccaagttttttggcgatgtcggaaaccggcatcgatgtggtgtccagcatttccgctccagctctcatacgcacgtcattgacgaattcaatcggcgtctgatcgaccatctcatggaagatctgcgcgcatttcgtacggccgacggaccctgctgaggcaatctcctccagggtgatctgtcgaacgtaattgtgctgcacgtaatcaatcatcttgctcaaaatagcaatcttcggattcttcctgtcgtatttggaagaaccattcttgccatgttcgcccgctatggccgtcagttcacgcaccatcgtataaaaacagctgagcacggtcaacgatgccgtatcatcctttaatttcatattgtcaacggtggcgggatgcatggtctgggcagccggcatctgaccgaatttcgcatcatgcagccgcatcatgcattccagcaacgcggatccatgctcatcttcgggatcacacaccatgtacgggagccgttcgtccgccatcaacggagccacaaagcgttcataaaccatgttcggcatgcacatgcatgaagggttcagcagagtgcaggaaaattcgcaatcggtgccgtcctcggtgaaaccgtaatgcaattggcgcgaattcacgaaaatgccttggccttcttcaagacgaatgctttcgccgttcacgaaataccacatgtgtccacggatgatgtgggtgaattcgaaatcgatatgccaatggcattccgcgcgcatgttcggatactgatgcagcagcgaatgttcggtgaatgagaagaacatcggcgcatcatattgcaccatttccgcgccgttgggcttgcgtccccagttggtgaccggcatgaactcatatggaagacgaccgtcttgcgcaagttcaggctgttccgtttgttcgttttgtccgacctgcacgtcacgaacgtctaatcccatctgtcccatgcaataccccatcagtggatacggtaaataatacgaaaatcaagaacgataatacaacgaaatacagtgtcaacgaataatgatgccgttgaatggaacatgatatgtcacgtcaatcgattgacgtaatacagcagaggaggcagcatggtggaacccaccaatcatccggcacgcgacgaatgggagcgtatgctctccggcgaactgtatgtggccgatagtccgcaacagcaggaagcgaatatgcgcaagcgtcgcttggtgcaggccatcaacacgtccgaatatgacgcgttcaaagaacgtgacgaactgtttcacgaactgttcggcgcatttggagagggtggattcgtggaacccccattcaactgcgattatggatgcaacacgttcatcggcaagaatttctatgccaacatggattgcattttccttgacgtggcacgcatcaccatcggcgaccgcgtgttcttcggcccccgagtgggcctgtacacgccgtatcatccgatcgatgcgacggtgcgttcctccggccctgaaggcgctcgtccgatcaccattggcaacgatgtctggttcggcggcaatgtggtggtcggccctggcgtcaccatcggcgatgatgtggtgatcggtgccggatcagtggtggtcaaggacattccttcgcattcggtggcagtcggcaatccatgccatgtgatccgtgagatcaccgacgccgaccgcgaatattgggaaggcaaggcagcggaatatcacgcttggaaggattcgattcagtaaatcgttagttcacgcaccgcaatttcactcgggtgcgggcattggctatcatcgcccgcaccccatcaatgtatttctcgtacatttcctacacgcaccaaccatcctcacatcatcatgcaatcttccatcacttggcgcgagtttcttcgacagacgttgacgctcgccctgcccatcacgtttcaacaactgatgctggcgctgtcatcgtgcgccgacactcttatgctgacgaacgtcggtcaaaacgagctgtcggcagtgtctcttgccacgcagttccagttcattttcagtttgtgtcttgccgcgctcacgcttggcatgagcattctggtggcccagtattggggtgcgggcaacacgaatgccgtcgaacgtgtcttggcgttcatcatgctgtatgccggcggattgtcgctggtgtttttcgcattgacgctactcattccggaaacgttgatgtcgattatgacgaacgatgcgacgctgattgccatcggctcacagtatttgcgggtttcgtcggtttcgtacctgttcatcggtttgtcgcaaatgtatttgtgtctgatgaagaatgtgggtgcggcggtcaccggaatgacggtaagcacggttggcgtgatcgtgcatgttgcgctgaacgcggtgctgatctatggttggttcggtttacccgcattgggtattttcggcgcggcgatttccacggtgatttcccgagccatcgaactggtgtggtctgtgcttgtagccagccgcaatggccgcccacgtttgcggttgtcgatgatgttgcatccggatgtggcgttgcagaaggatttttggaagtatagtctgcccgtgcttggcaatgagctggtttggggctgcggtttcaccatgtacaccgtgattatgggtcatcttggtacggatgcggtggcggccaattccattgcgaatatcgtcaaggatctgttggtctgtttgagtcttggccttggcaatgcgggcggcattcttgtcggtaatctgcttggccgcaatgctttcgatcaggcgaaggttatgggcgacaggctctgtgtactggtggcggcagttggcgttggaaccggcctgttgattatcgcggcacgtcctttggcgttgcagtgggcgggattgacgccgcaggccacgcgttatctgtcggttatgctgtttatctgcgcctattatgcggcatgcgggtgcatggccaatctgactatcgccggtattttccctgccggaggcgattcccggttcggacttgtctgcgatgcgagcgttatgtggcttgtcgtcgtaccggtcggtctgttggcggctttcgtgtggaagttgccggtattggcggtctatgctttgctgaataccgacgaatgcatcaagatgattcctgctttgctgcattatcgaaagtatcgttgggtcaacaatgtgacgagacagaccgattccgccgtagtatcaaacgcatgaaaaaccggtatcaacaaagcccgtgtcatactgcattgcacagtgcgacacgggctttgtcacttgccgatctcaatcatgtgattatttatttcatgagattgcgcagcacatactggaggatgcccccgttgcggtagtagtcggcctcgcctggggtgtcgatgcgtacgaccgcgtcgaattcggttgtggaaccgtcgctatgggtggcggtgacacgcacggtcttcggggtgatgccattgttgaattcttcaacgccggcaatatcgtacgtttcggtgccatcaaggccgaggctctcataggagtcgcctgcggggaactgcaacggcagcacacccatgccgatcaggttcgaacggtggatacgttcgaagctttcggtgataacggctttgacgcccagcataacggttcccttggcagcccaatcacgtgaggagccagtgccatattccttaccggcaagtaccaccagaggcacatcgtgttcgatgtagtctcgggacgcctcgaaaatggtggtcggcttctggtcgaggaaatcgtaggtgaaaccgcccggagtgacctcttctcccacggacgcgagcaactggttgcgcagtcggatattgccgaacgtgccacgtaccatgacctcatgattgcctcgacgggaaccataggagttgaagttcttcggttcgacgccacggtcggtcaggtacttgccagcaggactggaagccttgaacgcgccggccggagaaatatggtcggtggtcacggaatcaccgagcagcgcgagcacgcgggcgccatgaatgtcttcgacgggttccggtgtggccttcatgccatcgaagaacgtctgcttacgcacgtaggtggaatcctcattccatgcgaacagttcgccttctggaacgtcaagtcctttccaacgacggtcgccttcgaatacggaagcgtaatccttcaggaacatctcacggctgacggtaccatccaccacggcggcaacctcgccattggtgggccagatatccttcagatacacatcattgccgtccggatcctcgccaagcggctgagtttcaaaatcgaaatccatggtgccagcgagcgcataggcgatgacgagcggcggagatgccaggtagttcatcttgacgtccgggctgatgcggccttcgaagttacggttgcccgacagcactgaggtgacggtcagatcgttggcgttgatggcttcggagatttccggcagcaacgggccggagttgccgatgcaggtggcgcagccgaaaccgaccagctggtaaccgagcgcgtcgagatcgtcctgcaagccagccgccttaagatagtcggccacaacctgggaacccggtgcgagcgaggtcttgacccacggcttgggcttcaaacccttggcatgcgcgttgcgtgcaatcaaaccggctgcgatcatcacggacggattggatgtgtttgtgcacgaggtgatggatgcgatcgccacatcaccgttggtgatgtcgaagtcaccgcggaagtcggtggaaacggcaaccggctcctgcacggtcttgtccgtttcgtacgcgggcaaggtttcgacgaatttcgctttggattcagacagtttgatgcgatcctgcgggcgcttcgggccagcgatcgacggtacgacagtaccgaggtcgagttccaggtattcggaatactgcggttcgacgtagtttggatcggtggtgtcgccccacagcttgttcgccttggcatacgcttcgaccaatgcgatctgttcttcggaacggccagtcaagcgcagatagtcgagagtgacgccgtcgattgggaaaatgccgcaggtggagccgaattccggacccatgttgccgatggtggcacggttggccagcggcaccgaggcgatgccatcaccgtagaattccacgaatttgccgaccacaccatgctggcgaagcatatcggtgatggtcagcaccacgtcggtggcggtgacgccttcaggaatggaaccggtaagcttgaaaccgacaacacgcggcaccagcatggagatcggctgtccaagcatggccgcttcggcttcaatgccgccaacgccccaaccgagcacgcccaagccattgacggtggtggtgtgcgagtcggtgcccacgcaggaatcaagataggcaagagtcttgccaccgttttcttcgaccttggtcatgatgaccttggcgagatattcgatattgacctggtggatgatgcccgttcccggcggtaccacgcggaagttcttgaatgcctgctgaccccaacgcaggaactggtaacgttcgccgttgcgctggtattcgatgtccatgttctgttcgaccgcgtcggcgatgccgtacttgtcgatctgtacggaatggtcgatgaccatgtcggactgcacctgcgggttgatgacctcaggatctcccccaagatccttgaccgcatcacgcatggtggcaagatccacaatgcagggcacgccggtgaaatcctgcatgaccacgcgggacggggtgaactggatctcatgactcggctgtgcagccggatcccaatccaacagtgccttgacatgatcatccgtgatgttggcgccatcgatgttacgtaccaggttctcgacgagaaccttcaacgaatacggcagatgatcgatgcccggcagatctgcgatgcggtaatattcataatccttgccgtccaccttcagggtgtcgagctggtcgtcgcgcacagacatgctacctccgagctttttggctgtataacacagctgattattcgtcgcctacgatacagccaagttaattcagctctggcgtgtcttcttaaagtatgggacaatactcggaattttcggcaccaaacgcaaacacaccaagaacacgagtgccgaaagcaccattgccaccgccgtcgcagccagcatctgcccggtcggcaccaccagcgcgaagaaattcgccaccggttttacgagcatgcccccgaatccaattgcggcaaaggccaataccaatatgccacgccacgaatgcaacggctttgccacccgcgcaagcacgaacactcccatcatgagcagaataatcgcgttgacgccacgcagcatcgccaactgcgcacccgaatcctgcacattccacttcatgaatatcggcagcagccacgacgtggacaaaatcgacaatccgaccgccacaccgcagggcacagcaaaatgcagcacgcgtttcaggaatcctggaatataacgacgcgtgttcggagccaacgcaagaatgaatgccggcatgccaatcgtcaatccacccacatatgtgatgtggcgaggcagatatgggaatggtatctgcgtcagcaccacacccaacgaaatcagtgcggaatacacggttttcacgaggaataggcttgccacacgttccatattggccataacctgacgccctcgcgccaccacatcgggcagatgtgagaacttcgaatcgacaagcaccacctgtgccacggccttggtggcgggcgcagcattgcccatcgcaatacccagatcggcctctttgatggcgagcgcgtcgttcacgccgtcgccggtcatcgccaccacatgctcacctgcatgcaatgcctccacgatcgcctttttctgatcgggcagcacacgcccaagcacatccacgttttccagtacttgcgccagctccgtaatgtcagcgggcagctcacgcgcgtccatgaatcgtggttcatgttcgccggtcagatgcacttttcttgcgatcgcgccgacggttacgggattgtcaccagagatgatgcggcaacgcacgccttgttcacggaaccatgcaagcgtttcttcggcgtcggcgcgaatatgttcggaacagcacaccaatgcgacagggcacgatgccggattgagttttggatcggtttcgtaatcgtcgggcgctgcaccgtagattcgcgcgaccagcagcacacggttgccgtcattggcgagatcattgacttgtttgagtatatcggcatggtcgccgttgatttgggaaagaatgacttccggcgcacccatcgtccacactgcattgccgtcatagatcgaactccacttgcgcgccgacgagaacggtactcgtgcctcgacagtgccgtccgcaaatccctgttcccgtagtccagacagaatcgcttgccctgtaccgttgggctgtccttcgttcgataggtcgaatagagcctgtctgacgtcatgctcgttcacggtgcctcgcatgtcgtcggggccacgaacacccagcaattccaacgaatcgagtcggatggtgccgtcggtgacagtaccggttttgtcaaggttcaggcaatccacacgagcgagagtctccacggattccagctcctgcaccagcgtgttcttacgtgccaaacgaatggctgcgagcgcgaaattcagcgaggtgagcagcaccaggccttcagggatcataccgaccacaccggccactgcggaaatgaccgcggaacgccattcgccggtcgaaatggccacattccagccgccaacagtgcgtacctgcgaccagatgagcagtacgcagagcggcaccaccaggaaggtcatgaatttcagaatcgtgttgatgcccttgtttaggtcggatacggttttcctgtaaaccttcgcccgtgcggtaagtttggccgcgtaactgtgctctcctacggcggtgactttcaccaacgccatgccggagatggcggtggatccagagaaaatatcgcagccttcgcccttgcgtacggtccgtgattcgccggtaagcatggattcgtccagctccagtccccaagtgtgcacgatctgcgcgtccgcgggcacctgttcgccggaacggatccacatgaaatcaccgagcacgatatcgttgtgcggtatttcaacgtctttgccgtcgcggtgcacaagatagtcggaagccaccagaatcgacagtttgtcaagagtacgcttggctttcaattcggtgcagatgcctatgccggtattgatgatgatgatcatgccgaacaccgcgtctctccacgatccagtgatcaataccataaccatggccgcaaagatgatgccgttgaacaaggtgaacacgttggctcgcacgatatcgataagcgaacgtgaggtcgatgccttgaccacattgtccaatccgctttccctgagggcgatcacttcgccttgtgtcagccccgtctcttcgatgaggggcattgttcgactttcgctcatgattgccagcctaccgtcacactcccgttttccggtcaacttcttgtgaaacacaggtaaaaatcagggaattttcagggtatttcatcaaaagacgaactgctggtcattcataccgacatggtgcaaaaccatatcagtgggtaatcgtggttaccagcatttcccggtcgtgaggatcattattagccacggccacagcagcatcgtcgagcggtatcgcgtcggtcatacgatcgttgaccgtcatggtagccgcatacagtttgttgtctttcggcacggcgataggattgagaagcaccactggaacgcccgctgttcttgcggtttccaaagcatcattccagttttcggcattggcttcgttcgcgtcgattcctgcgatgataatgaggtcggccttgcgttgcgccatgtcacgcacgccttgctgcgcggtggattgcgcgtccacagtgcccgagacggtaatgtacaccggcttgagtttaccggcttccatggcatccattgccatggaatcggcggtgacatcatccgatccaatcatggcgatggacaggctgtcacgatcctccgtggagtgcgccaccgcagtattgggagattgcgtatcccccaccgcggcattcgacggcacgcaaccagatagcgccgcgcaagacaacgcaatcgcagtcattccaaaaaacgcacgacttgcgaataacggcatgctcactgttcgtgctttctgaacagcgccacagtctccacatgatgggtcatgggataaatgtcgaacgcgcggatatccgccaattcgtagccaagtaacacgagcgtggcggtatctctggcaaggcttgccggatcgcatgcgatatagaccacacttttcgcttcggcttcggcaatctgcctgcacaccttcgcgcgagcgccggcacggggcggatcaagcaccaccacatctggcttggcgagatcattgcgcacgttggcaagtgttttcgccacgtcgcccacacgcgcatcgacattacccagatgaatgtgcctcaaattacgttgcgcgttccttaccgcagttttgccgccttcgacgctcaacatgcgagtgcgctccgccgtcagcgtggccaacggcagcgtgaacagacccgaaccggaatacaaatcccacagacatgcggatttggcaccgtcaagctcgccgcgtaccaaatcgatcacatggttggtcaaagcgatcggcgcatgcctatgcatctgccagaaaccgcctgcatccacgttgtattcgaattcacggccggcgacaatcaccttttccgtaagctcacggcttccagcaaccacctcgccgttcacaagcacggcgtaattgtctgaaatcggcgcattatcgcgaggttccggaacggatagacgaatctgggaacccggttcgaagctcccttcccacacatgctcacgttcggccacttccagcaacgtacggctggccaacggcatggtatcaatcggaacgcgcacatgcgtgcctcgacggtgcatcgacggacgcccatcagcatcagcaatcatctcgatgcgagtacgccaatgcaaacctcgctccgcatcgtcttccgacatacgctcaatgggcacttccacgtcgacgtggccgagtcttgccatctgttcggccaccgacgtgactttccatttcagttgccctgcaagcgacacatgcaccaagtcagcgccgccgacaccaccgcccatggcaaggggtccagctaacgaccatattggatcagtacggtcttcgctcgcttcgagtacttccaccacttcgcctgtccagaagcgatcctcacgatcatgcggctcgtccaatgcgacacggaccagttcgcccggcaatgcgaatcgcacgaacacaacacgtccgtcaatatgaccgacgcaacgaccctggtcggcgtaccgttcaatgcggatggtcgattccatcagtgctcttccctcatttcggtagtttgtgctgcctcagcatcgtcttcagaaacttcctgcatcatcttatgtcggtgcattggcgtcgccacgatcagatacgagacccaaatcgcgagcgcccagaacggaatgcccatcagcagacgcgctgttcccagccagccgacgtgattgccgagatagagcggcacctgcacgatcagacgcagcgcgaacaccccaacccacattgcggtgatgatggtataggcgcgattgagcgccttgtcacctcgccaatcggcaagccaggcacgaaaatgttcagtcggtaacgttcggatgaactcgatgaccaatcctaagccaggcacccggaccagcagtgagatcgtcagcaaaacaacgtaaaaggcgttggtgagaaatccgaacatgtaatagttacgtgcctcgtgactgttccatgcccagatcaggcaaatacctactgccagcaagcctgataccgctcccatgacggactgtcgttggcacaggcgcacgatcacctgcagcacggccaacgcagcggacacgccgatggtcagttgcaaattggacgtgatgacgaacagtgccacgaacacgacgcccggcagcatcgattcgataacgcctctcggaccgccgatggcgtcgatcacggaaaaatcgtcagtattaccggcgtcggcaagcgcaccaagaccagttcgttttttcgcttcggtttcagccatacgtattagctatcggttcaagcggctcaacgcacttcggagaacatcggtccacgagacagcgtggtcttgacctcaacctgctggtcggagtcgaatggacccttcggtttgccgggaatctcagtcttctgctcagcctcttccgcagctgccttcgcagccttgcgttcggccggagcgaccggcggatgcatgggaataaggtcgcgtggcgccaacggatcatcgcctcgttccaccacaatatcagcgaagaactggttcaatgcctttgcttcctcaccctcaggatcggtggcagccttgcctgagaagatgccgcgcaacatccaacgcggaccgtcgacgcctacgatgcgggtaagcaccttgcgtccacccttgacggtaaccggcaatgccagttcggtgccgaatacgccttcgacttccttcgcatccttgttggcttcaatcaggtcggcacgaacgtcatcccacaatccgaacgtcttcggtgccgcgaatgcctcaatctccacactggaggaaccgtaggtgatggtggtgccaagaacctgctgggtggcacggttggccttcactcgcaattcaatgcccttcaggaacggcagataatatgatcccatatcgaggtactcgtcgtagtcgggaacgttctcatcttccacatcccacggaccatgctcgtcaccgcggccctcgtattcagcggaaggctccggaagcgccacgacttcctgagcttcgtcaacattttcagctgcgtcgacagcctcttcgttttctccggcggccgcttcaagagcttccttgctctgatgcttcttcttaccgaatccaaacaatcccatgatgttcctcatttcataacagttgcaaccgtgaatagcctagcacctatgcttaatatgggctgggaatcggggtgtgatattccaattcccagtctgttcacgataaaaagtggcttaaatgtcatacataatgctgagcggcgcatgatcggaccagcgcaggtcgtaggtcggagccttatcgatcacgaatccgcaggccgtatccgccagttccggtgttgcgaactgatagtcgatcctccagccgacattgttgtcgaatgcacgaccgcgctggctccaccatgtgtacggtccttggatgtctccggcgagattacgcatcacatccacaaactccagttctcccaaccatttgtcgacatatgcgcgctcctcggggaggaacccggcatgcgtttcgttggctttggcgtttttgatgtcgagcggcgtgtgcgcgatgttgaaatcaccgcagagcaccgcttgttttccgccgtgtgctgcctcgtcacgcaactgttccatgcgtatcagcatggtgtcgaggaaacggtatttctgcttcattttttccggatcatcggtatttcccgcatgcacatacacgcaaaccacggtaatgacatagccttgtggagtttgcatgtccgcttcgatccaacggccggaatcgacgtcatcctcaagtcccggcaatccatatcgtttgtcgacaaccggcaatgccgacaacagacctacgccggcacgccccttgatacggcaaatctcgttcatacgatgcagttcgctctgatcggaaatacgtcccgccgttgagtattcgaaaccgaattcgtcgaaaataggatcgatttcgttttgcggggcacgcacctcctgcatacaccacacgtcaggtgtgttgcgtccggcccactcctcgatgcctttgcgttttgccgctcggattccgttcacattggaagtcgtgatagtgatcgtcatagcgttctagcctagcttgcatacaagaaaagccctcggcacatgccgaaggcttatcttgatgatgttatcgcatcaaatcagtcaagaccgagctgcagcttgccgccggggatggcgccaagcagatcacgggtgtactgcttctgcggatggtcgaagacctcgtcagtggtggcgtgctccacaagcttgccgtgctgcatcaccacaacctcatcggcgatctgacgcacaaccgccaaatcatgggtgatgaacaggtagctcaggcccttttccgtctgcaggtcattgagcaatcgcaacacctgatcctgcaccagcacgtccaaagcggatacggcctcgtcgcagacaatcacgtccggatcgagagccatagctcgtgcgatggcgatgcgctgacgctgaccaccggaaagctcgttcgggtagcggaaacgcacggaccacggcagttccaccatatcgagcaactcacgcacgcgggcagcacgactcttcttgtctccaatgccgtggatacgaagtggttcttcgatggaacggtaaatggagtacatcgggtcaagcgagccatacggattctggaataccggctgcacgtggcggcggaagtcaagcaattccttgccttggaagccggaaatgtccttgccttcataagtgacggtgcctgaggtcggttcaagcagcttcagcaccatgttggccaccgtggacttgccggaaccggactcgcccacaattgccagcgtggtacccttcttgacggaaaagctcacatcgtcaacggccttgaacatctccttcttgcgcggcagcttgaactcgcgtgtcagatgatccaccgtgatgatggattcgccggacttcagggaatcttcattcaccttgtgttccatcacgccgctggcatcgccaccatgctccttgacggagatgatgcgctgcgaggccaacgacggtgccgccgccaccagtcgcttggtgtatggatgctgcggatgctgcagcacttccagagacgggccggattcaacgacctgccccttgtacataaccacgatgtgctgcgcacgctcagccgccaaacccaagtcatgggtgatgaacagcactgcggttcccaacgaatcggtgagcatctggagatgatcaagaatcttcttctgcacggtcacgtcaagcgcggaggtcggctcgtcagcgatcagcagttccggacggcatgccaagccgatggcgatgagcgcacgctggcgcataccaccggagaactcgtgcggatactggcgtgcacgagtggcggcatccggcagaccagcctcagaaagaagacctgcgatgcggtcatccatggtggagccgattacatacttcttggcgatgtaccaagcgtcatcctcggccacgccgaccttgatcaggtcgtcggccacgcgccaacgcgtttcagatcctgggacccactccgactcgaagtacgccacggtcttgtcgaagtcgtcgccggtcttaccgatcttggacagcgcttccttcgccgcggacaacagctcaggaagctccttggagccaaggaaagtttcatcgtcgttgcctttaagttcgacatcggcatcggcgagagccttcgacagcgaggaacgcttctcatgggcgatatccatattgttggcggccagagcctccttcacctgggtaccgatacgccacaccgggttcaggttgctcattggatcctgcgggacaagacccatcttgttgccgcgcaacttgtcgaaatccctctgcttgtaaccggagatttcctcgccgtcaagcttgatggatcctccgaccacatggcctgtgcccggaagcagaccaagcaccgccatagcggacgtggacttgccggagccggactcaccaacgatagccacccactgacccgggtatacgctgaaagaggagttgcgaaccgcatgtaccggctggccatcatcagtggtgaagtcgacctggaggttcttgacttccagcagcggaccgttggcacgttgcatggcctcgagcttgttttcggtattcatttcagtcatcgaatatccctcacttacactcacgtacggctcttcggatcaagcgcatccttcacggcgtcacccatcatgatgaaggcaagcacagtgatggcaagtgccgcggacgggtagaacagcaccatcggatcggtacgcagaatggactgcgcattggagatgtcgccaccccagctgacggtagtggtcggcagacccacaccaaggaagctcaatgttgcttccaacacgatgtatgtagccagagacgttgtgcccaccacaatgatcggtgccaaggaattcggcagaatgtggcggaacaggttacgccacggcgtggagccaagtgcggtggaagccgtattgaactccagattcttagcttccataacagcgcctcgcgcaattcgcgcaacggatgtccagccgaataacgtcatgaccagaataatcttccaaatggaatcgttggtcttgaacatctgcagcaccacgatggcaccaagcaaaatcggcaaagccaggaaaatatcggtcaaacggctgagaatggtgtcgacccagcctccgaagaaaccgctcaacgcaccgatcagcgtacccaacagcaccaccagcaccgtagcgaacacgccgacgctcagcgaggtacgagtaccatgcaccacgcgggagtacacatcgcagccttgcagatcgaatccgaaaggatgtcccttcgaagccggttccaaggagttctcaagcgtgcagtagttcggattctgcttggtcatcactcctgggaacagcgccacgaagataatgaacacaataagcacagcggaaatgatgaacatcgggttcttgcgcagggtacgccatgcgtcagcccaaaggcttgaagccggtgcggactcatctaccgagtcaacgtccttaagcggcgtctcctcgagaggagcaacatatcgttcctgtcccggaagcgcgtgagaaagattcgtctcgttcatatcagtcattgttcaatcctcccaactcacgcgtagcggattcgcggatcaagcgccgcatagagcatatcgaccagcaggttgcacactgcgaagatcagcataagcagagtcacaatggacaccaccagattgccttcacccttgagaatgctttgataagtcaggtaaccaatgccatgcacgttgaagatggtttcggaaatcatggcaccgcccatcagtgcgccaagatcctgaccaaggtaagtgacgacaggaatcatggagttacgcaaaacgtgacgattcatgaccgacctgttgtccatgcctttggcacgtgcggtgcgcacatagtcaagcgcgatattggaagaaatctccgaacgactcaatcggatgatatatgccatagacacagatccaagcaccattgctggcatcagcaggtcgatgaatcctggattggcaccggccgtaactggaagcagacgcaacttcacgcctaagaaatactgggcaaggaagcccgtgacgaaggtcggtacggagatgagcaacagagagataatcaggatcacggtatcgcaccacttgcccttgttcaggccggaaatcgcgccgaagatcacgccgaacacggcttcgaacacgaaagccatcagcgcaagcttgatggtgaccgggaatgcacgtccgatctggtcgatgaccagctgaccggagaaagtcttgccgaagtcaagagtcagcgcatttttcaggaacagcaaatactgcacgatgaacggtttatccagattgtattcggcacgaatctgcgcggcgacggcctcattgaccggcttatcgccaaacatcgccttaaccgggtcgcccggcaacgcgaacaccagggcgtacaccaaaagcgtcgtgccgagaaccacagggatcatctgcagaatgcgtcgcagaagatatctgcccattggtttctccttttttgcttattcattgtcaacctttttcagattattactcataatcatcggggaaggttaacgatttaccccgcaagttttgtggcaacacacaacaaactgctttatattgcagtttcatgggaatcagctgggaaaaatgcttggctaccggcatctacccctgacgcctcttggccacactgatgtcaccctgaaacggtgcgtattacatggaaaggaaggaacggatatgatccgccccttcctgcaattggctcagcgagattcactcacgaagatcggctcacttgccggacttggtcatgttctcgtagaccggcaggttctgccagttcatttcgaaaccggaaacgccggtagcagccacaccgtaggcgttggcgtagtacagcggaacggccgggagatcgttgagcagcacttcctgagcctgctggtacagcttattggcctcatcggtggtctgtgcggcagcagccttggagcacaggtcatcgaactccgaattcttgtaatcgccatcgttggaaccattgccatcagcggcggcggaagcgtaattggccaccaggtagttttcggcggacggataatccggctgccagccgctacggaatgcgccctgaaccttgcgatcggacacggcggtacggtaatcgttgaaagtcgggtacgggttggtggcagccacttcggaaccaagcgtgttgttgatggagttcaccacagcggtgtaggtggtctcgtggccaccgtcagcgttgtaagcgaaggtgagcttgtcatcggaagtccacgggctgatggcattggccttctcccagagttccttggccttcttctcgttgtacttcaggttgccgacgcccttgagggaatcagagtagcccggggtcagcggagaggtaaagtcaacggccggagtgccggtaccgttgagcaccttgtcgcagatgttctcacggttgatggccatggagatggcttgacgacgcagggtgccttcttcggtaccagcttcgaagtgcttcaggctggacggaatggtgaactgctggatgacggaaccagccttgttgtaggcctgcacggtctcatcggtttcgaaggtcttggtggcggaggccggcacggattccatcacatcgagggcgccggactggatgtcggcgtaggctgcgtcatccttggtgtagaccttgaaggtcacaccgtcgttcttcggggttcggttgcccttgtagtcagggttcttcacgagcacgatctcgttgtcgtgatcccaggactggaacttgtacggaccgttgccgactggagcctcaccgaaggcatccgtgtcatcgtagaaggattccggcagcggagcgaatgcggaatagcccaccttgatggcgaacacggaatcagacttgttcaggtcgacggtgaactcgtgatcgttgacgatcttcagaccttcaagctgttcgtcacccttgaggttgtcggtgtcctgcagcgcgtcatagcccttgatggtggagaagaaggatgagccgaccataccgttcttggcgttggccacgtagctccaagccttggtgaaggactcggcggtcacatcggtgccgtcggtgaacttccagccatccttgagcttgatgtcgtactgggtggcgtcatcgttggcggtaatggactcagccacttcgttggaagcattgcctttggcgtcgaaggaaatcagacgggagaacagcagatcaaccggcttgccaccaccggtctcgttggtgttgcccgggatgagcgggtgctgcggttcggaattgtatgcggtgatgatgttggcaccttcagcggcggtgtcgctgccgttggaagagccacagccgctcagcaacatgccaaaagcgcacgcggcggcagcgaaagccagtgctttcttcttcatataatcattctcctattcgatatcacatcgggattatcatcccacaaacggaaacgagccgacctactcaccgacgcatctctatttggcgatagtgcactattcttgctcaattgacggacaacctttccatgcaacccaaaaaacgcacaccttccttgacgacatgacggcggaaaacatacgttttccgccgtcatgtcgaacaatgtatccgaagaataagtcagctcttcgaaatctcgttatacaccggaacgttctgccagttcatgacgaagttcttcactccggatgcggcaacgccattggcattggagtaatacagcgggatggcaggcagatcgttcaacagaatctcctgagcctgctggtacagcttattggcctcgtcggtggtctgtgcggcagcagccttggagcacaggtcatcgaactccgaattcttgtaatcgccatcgttggaaccattgccatcagcagcgtcagaggaatacagctggtacaggtagttttcaggagacggataatccggctgccaagcggtacggaacgcgccggtcatcttgcggccggtaacgtcgtttcggaattcctggaaggtcggcaccgggttagtggtcacgtcgatatcgagcgtgttcttcacggagttcaccacggcttcaaagatcggcttggctccgccgtctgcattataggagaacgtaagcttgtcgtcggaagtccacgggctgatggcgttggccttctcccagagttccttggccttctttttgttgtacttcagattctcgttgcccttgagcgaatcggagtagcccggagtcttcggagacgtgaattcgaccgctggagttcccaaaccattcagtaccttgtcgcagatggcctgacggtcgatggccatggacaacgcctgtcggcgcaactgtccttcttcggtggatgtcttccaatgttcaagatccgacggaatggtgaacgtctgaatcacggaaccggccttgttgtatggcaccacggaggaatcggattcgaaggtcttgctgtcggcggacggcaccgtatccatcacatcaaggttgccggcctgaacatcggcataggccgcgttggcatccgtgtagatcttgaacgtcacaccgtcgttattcaccttgcgattgcctttgtaatcgggattcttgaccagcttgatttccttgtcatggtcccaggaatcgaacttgtacgggccatcggaaaccggcgactctccgaagccttgtagaaggattccggcatcggatagaatcccgaataacccagcttggtggcgaacgcggaatccgactggctcaggtcgacggtgaactcgtgatcgttgacgatcttcagaccttcaagctgctcgtcacccttgaggttgtcggtgtcctgcagcacgtcatagcccttgatggtggagaagaaggaagagcacagctgtgcgttcttcgcattagccgtatagctccaagccttggtgaaggactcggcggtcacatcggtgccatcggtgaacttccaaccatccttgagcttgatgtcgtactgggtggcgtcatcattggcggtaatggactcagccacttcattctgggccttgccatccttatcgaaagacaccaacccagcgaacagcagatcgataggacggccaccgccggtttcattggtgttgcccggaatcaagccattctgcggttcggagtcaaatgccgtaatgacattcgatccttcagtcgcgttcccagacgtggaagacccacagccgcccagcatcatgccaagcacacaggccgccgccgcaacggcaaacaccttgcttttccttatactcattatgttttccctcattattcggattaccggtcggtattgtttccccgtaccagcttcatctaggtaatacaccctaaatcaagaagaaacaccaatttctgttacaggaatgtaacgaaatatccatggaccgcgactacgcacgaggaaatgcctgaccgtatcgggctttcaattgttcgatggagacatgcgtgtaccgttgcgtggtcttcaacgaggaatgtcccaagagctcctgcacctcacgcaaatccgctcccccgtcaagcatatgcgtggcggcactgtgccgcagagcatgagggctaatgtcgggaacgccggcatcacgcgcgcattcgtgcaccacacgacgtaccatccgctgatcaatgcgtttgccttgtctcccaagaaacagcgcagccgcggactgctcccccaccaacaggggacgcccatcatccagccaccgacgtatcgctttttgcgccggagcgccaaatggcatgactcgttgtttgttgcctttgccggtcactttgaccgttcgattggaaaagaccacatccggcacatcaagtcccaccagttcagccacacgcatgcccgttgcatacaacagttccagcattgcggcgtcacgcagctcaatggcctgctgcttcatggtccgttccttcggctgagacgtttcaccgtcctcatccacgcgttccatcagctgttcagcctgtgattcgctgagcacatccggcaacgtatcaggtattttcggggtcatgagcgcacaagccggatccgtcgtcgtcacgccatgctcatgcgtccacgcgaaaaaaccacgtacagccacagtttttcgggccatgctgcttttcgcatggtttttcgatgattccgccatccacatgcgaagatcttcgatggtcacctcgttaagatccctgcatctaagccgctccaaggcaagcagacattcttcgacatcgcctcggtatgccttccgtgtgttttcactcaatccacggttggctttcagatatgtatcgaatgcctctacgctcttatcgaacagcatgccgatcagcctttcccgagctcaacagcaagcccgaatccatgaatttctttccattatgtgtccattctccgatagaaaccgaaataccggcacaacttgaaaggagaccaactatgctgtccagtagcgttcgctcagcgaatccgtcgatgatcgtctattcgaaggggagattatgccgattccaaacgaaattccagcaggtgcacgcattgtggtgcgcacctgcgaaggtgtcgatccaaaggaccagcgcatgaaattccgcgattatgtcggtcacgtacgttcttgggacgggcagacattggaaatgacgcgcgatgcggcagccaacggttcacgcccagagcaacgtgtcagcattcccgccgacaccatcgtcactgtcaaaccggttccggaacgttccatgacacggccgcgcccatagcgcgtcacactgcggaacgcacctgtgccatagcttgacggtaaccgtcgaatcgcacgatatgctctcccctacgcgccgactccagaagcatctgctgccatccggtttcgggaattgccagttcgaccgtttcgcaacgttcttcgaagtcaggttctttggcgagagccttgtgttcacggaatggctgcccttgtatgaagaaacgcgccatctccttgtcgtcaccggcagtgggcgagccctgttgcgtggtcatgccgtgcagcacgttggccataagcgtcaaccgattggccatattacgcagcaacgcttcgacattggcggcgtcctcttccaccattgcacgggtacggtttggatcggttagcgcaacacgagtcatgtcccgccatgaaccagcggcgagcgcggctgcgatgttccggttgggattggccaccagctcgttgatcatagctgtggaaatgacgtgtggcatgtgggaaatcagtgccgcgcaacgatcgtgggtcgcatcgtcaagaacgatgagtcggttggaacaatgatccacaatcattgtcgcaacggcgcggaaccgctgatactcggtattttcatctacggtgatggcccagagcgcgccatcgtaaagcgtcggatccgacgattcccatccggacagctcattgcctgccatgggatgcgcgcccacatagcaatgttccaatccaacggctttaacctgttcccgaaccattgctttgacactgccgacatcggtgagcgtggtgatgtccgtatcgatcagtggcttcaacgcacccaggatttgcggcatggccttgagcggattgcataacacaagcacgtcaggttttgtgtcggcgagcgcggccagtgtggacacacatcgtatgccgtccgctttcgcagtttcatatggacgatcgttatggttccatgcgatgacttcacagccagcattaacgagtctgcgagccagtgaccctccgataagaccaaggcctacgattgcgatacgctgcttcaccacatcagctcctttccgaccgtttcgctgttctgccaatcatctggcagatgctgttcgtcaagccgtacgcctccctgcggcagcatccatgaggtgactggaggattggggcgttctcttcgtgggtatacggccagagttttggcccagtcaccgtgttcggcgatttcgaccagcgcgccatggaagcgttgctcccatggcgccgcatcgagcgtcgcgataaaactgtatgtgcctgtgcgtcctttgattggccgcgagatgaaacttgtcatattgaggcctgcatcgcggaatacgtccagcaggttcgcgagtacgccaggacctgtgacaagcggaataagcgtcagcacggattcgtattccatatcagcttgcgaacgaggctgttccaacagttttccggcttccttgcgtggtgcgagcacaagaaaatcagtctgtgcgccttgataatcctgcacggcggtaccgatgcgcgtcacattgtagagttcaccgcaaatacttggcccgaaagctatttcgtttgctttgatatcgcgacatgcggcagcattggatggcgctggagtcggttccaaatggtgttccgcgatgaaacgtttgcattgcgcgagaccatgcgcgtgtgcggtagccacggtggcgtcttccggattggatcccgcacgcacatatgcgtcgaaagttacgtcgacacccactcgcgcaaatccgactagatctttggcgtcgatgagcgcgtccagattcggcaccacgtaaccttcgacgttgttttcccatgccacgacgccccatccttcgccccgctgcgcggcatcaaggatttgcggtacgtcatccgcagccaccaattcgaatccttccggctcaagatgggccagtgcctgcgatgcattgactgcggcctgatgggtgaaggtgccttgcggacctagatagaacagctttcgtgcgctcattcaaccccattccttattcttggtgttcccctgaaccttacctcattgccgtggaatcgactgccgattattccaccggttgggcgttatcagatgttttaccctcgttcgtctgcgtatcagcagcaaacgcaccatcacgcgtctccttacgcggaggtgtgacgaaccaacgtttcggcagcaccagcatcacaaccggaataagcacgacaccgtacagccacatgtatcctgcctgttcactgaagaacggcatgggatcatctccaccgaatcccacaggaatcatggcgtctcctcccggaccataccccgacatcaccgtccagaccaccagagaggaaccgatcaggtgcaatgcgaggcctgagacaccgtcgcgtgatcgagctgaccatgtcgaaatgatcaccatgagataggcgatcgccaatccgtagggaatattcatggatgcgcccatgcgatgggccatggttcccactactccgactatgattccggaaaccagatcgacgaggaaccgtccccaaatcggcagacggtatgaccatggcatcagttgcgcatcgggcgccgcgtcttgactcgacccatacgtatcatgcgattgcttcatctgttgcatcatatcccctactatcgctcaccaacctgaaaagaaaaagagatacgcgaggacacgtatctcttttttcatggactcaataacagaatcacttgttcttctgagcgttattctgctgagccgtcaaacggagagcccagcgggctcaccgtaggcgaagtgagcaagcacactaccgtgcttgcgaagccgacagaacaacgtgaagaatcacttgttattctgagcgttgttctgtcgacgctgcttggcgcgccacttgtaccaatcctcacggctgagaatgatcttgcgcacacggatggattccggagtgacttccacgcactcgtcctcgttggcgaagtccaaggactcttcgaggctcatcttgatcggcggagtcagggtttcgagcacatctgcggtggaggaacgcatgttggtcatatgcttggccagcgtgatgttcacatccagctcgtcaggcttgttgttcacgccgacgacctggccttcgtacaccggagactgcggttcgacgaagaagttgccacgtgcctgcagacgctgcatggcgtacggagtggcgatacccttgcgatcgcagaccatggaaccgttctggcgggtcacgatctggccagcccacggagcgtagccggcggagatggaggatgcgataccggtgccacgggtggcggaaagcagtgcggtgcggaagccgatcagaccacgggacggcacggtgaactgcagacgaacccagccagtgccatggttggtcatgttctccatacggcccttacggtcggcgagcagctgggtgaccgtgcccatgtactcttccggaacgtcgatggtggtgttttccatcggttcgttgatcacgccgtcgatggtcttggtgaccacctgcgggcggccgacggtcagctcatagccttcacgacgcatctgttcggcaagcacggccaaggcgagctcgccacgaccctggacttcccatgcatccgggcgttcggtcggcagcaccttgatggacacgttgccgatgagttcgcggtcaaggcgatccttgatcatgcgggcggtaagcttgtggtccttgccttcggttccggcaagcggggaatcgttgatgccgaaagtcatggagatggccggatcatcaacgtggatcagcggcagcgggcgcggatcggacggatcaacgatggtttcgccgatcatgatgtcattcacgccggcgactgcgacgatgtcgccagggcccgcggaatcgaccggggtgcgctcaagaccctgcgtacgcagcagttcggagacgcggaagttttcgacggagccgtccacacgggacagaccgtaggtcttgcccttttcgagagtgccgttgtagatacgcaccaagccgagtcgacccaggaaatcagaggaatcgatgttggcgacgtgtgcctgcaaaggcgcgccttcctcgtattccggagccggaatgtttttgatgatggcttcgaacagcggttcgagatcttcgttatccggcagaccgccattctccggctggttttcggaagcgtagccggccttggccgcgcagtagatgaccggcaggtcgaacagcgcatcctcatcgagatcgataccctcttcgataacgtcctgagccaggccgagcagcagatcggaggattctccaacgacctcttcgatacgtgcgtccggacgatcggtcttgttcacgcacaggataaccggcagcttggcttccaaagccttgcgcagcacgaagcgggtctgcggcagcgggccttcggatgcgtcgacgagcagcacgacgccatcaaccatggagatgccacgctcgacctcgccgccgaaatcggcgtgaccaggagtatcgatgatgttgagggtgatgccttccggatggccgtacttggcggccagcggaccggtgtactgcacagcggtgttcttggcgaggatggtgatgcccttctcacgttccagatcattggaatccatcacacgatccggaacttcctcacgttcgttgaacacgtgggactgtgccagcatggcattgaccaacgtggtcttgccgtgatcgacgtgtgccacaatcgctacatttcgaatatcgccgcgaaccgccatcgaaacctctcttagtattgctgttctcttgcgttaccgttcggtacatactggttatcggtacttacaaatccgtactccacacaaaccgagccaatcctagcgaaccattacgacagttccggtcccagcgctttcgcccacatacaaagtttgcggttgtcgaatctcaacaaccgcaaacgtatgatctcttgggaccactcaaaataattcgttaatcctcaagttccttaccagtgcgttccggcaagcacaacgccgcaacgcaggccagaatgaaggcgaccgcgaaaacgatgaatgccaccgccttgttgccaccggacagcgtcaggaaccacggcatgagcagcggagctatgatggcagccactcggccacatgccgcagcagcaccggacgcagcagcgcgcaggcgggtcggatagatttccggagtcaccgcatacagcacgccccacgcgccaagattggatgcggacaacaacatgccaaagcccaacaccgcagctacggaacccgcttgcgagaaagcaaacgcggccacggccgacacggcaaggaacacgctcagcgtcttcctgcggccccagatctccaccagccatgcggccaggaagtatcccggcaactgcgcgacggcgatggccagcgtatagccgaacgacttggtcagcgagccaaactggtcggccagcagcgacggcatccatgtgaacgctccatagtaggagaagttcacgaagaaccacgtggcccaaatggctgcggtgcgcgcgatgcactttttgccgaacagttcgcgggtgttgatcttcggcagtggtttgcccttcggggaagccactggctcgatgccacctgcctgttcgaaatagcgtacggcctgttcggcttcgtcctcacgccccttggattccaggaatcgcacggattccggaatatgaacacgcgtcacaatggcatacagcagcggcaacgcgccaatgagcaaagcccagcgccaaccccaatcgccggtattcggaatcacaaagtagccaatgcaggcggcgacaatccagccgacagcccagaaggattccaacagcaccgtcatacgaccgcgttgtttggtcggagagaattcagaaaccagagtggaagccactggcagttcggcgcccaaaccaagaccgatgatcagacgagcgatcaaaagcgcggccaacgaccatgacagtgccatgccgccattcgccaaaccgaaaatcaccagcgtcgcggaaaagaccgttttgcggccaacacgatcggctacaaaaccacccagcgcagcaccgatcgccatgccgacgaagccgatggacagcacccagcttttctcggttggtgtcagattgaaatgcgggtcagccgcgatggccgccacaacgaaggacaccaagccgacgtccatggcgtcgaaagcccagccgataccggacgccaccagaagtttcctatgcgctttgttaaacggcaggcgatcaagacgctcattgcgtgtcaacgaacccgacgaagcaaccgatgcggattgcacggatgtcatacttcttcctctcatacgaaacgaccatgcctacaaggcatgccgaaaaccagacagaatcgtctgaaaaggaaacaatccgaaaagacgtcagatcgtcgtcaacgcggaaagcacatcatcctgcgtttcccgcacatcgaaatcatggcgatcccgagcatcgctccatgtcgactgtcggagcacatccatggtgtagcgatacaccgttgccggacgattgcgtccgacacgcaatttgtcaccggtgtcctccagctgcccggatgcgagcatcttacggcggaaattcgccagatcgatgctctgaccggcaacggcctcgtacacgtcatgcagctggctcagcgtaaacctctcgcctaccaatctggtgacgatctgcggatattcgattttgccacgaagtctgctgagggcgtagtccacgatgtcgccatggtcaaatgccaactcaggcagatcatccacaggaaaccatttgacattgtcgtcgatactctgcccgagttgcccgttaagatcgtcgaccaacgcccaatagacgatggataccatcggcagcccgccgtgtgagcgcgccggatcgccgaatgtatacagctgttcaagataccgtggatgcaacgatgtcgtggattccagcgcaacgtaggcagattgctccagcgagtggtcagccctcaaaccaccaccgggcaacgcccactggccaagaaaaggctggcgcacgcgccggaccagcggtatccacaaggtggatcccgcactggttcgagcatgttcctgcgttccgtgggaagctggccccaaagcgagaatgaccacggaaacgcccacctgcggcggctgtttgcgccgttctgagacattgcccatgatcatcgcgcctcacctctccgatcttttgtcgatttgaattgttccggaatcacagtgtagcacttatagtcaacatgactataagtgcagtgtttcaccacaccgcttgaatttcaacccacgtatgcccttcaacgaaaaaggccccacgaaggagccctatgcgtcttatgcgacgatgccctgagcaatcagctctcgggcaacctcacgatattccttcgcggtcttatggttcggcgcataaatggtgataggcgcggccgcaaccgtggaatccggaagtttgatggaacgtgagatgactgaatggaagaccttgccttggaatgcctcataaatacgctgcaacacttcatcacaatgcaaggtatgcgtgaacatggtgacaagcactccgtacacttccagactcggattgatgcgggattgtactttttcgatggactgcatcaacaaggccacgcctcgcagtgcgaagaactcagcagccacgggaatgatcacgccatcggcagcggtcagcgcattcaccgtaagcaaacccagagaaggctggcaatcgacgatgatcacatcgtattcatccttgacctgacgcaacacgccagccagcacctgctcgcgcccaacttcggtgaccaactgcacttcagcggcagacagatcaatgttggccggcatgatatcgagattctcgaaatcggtatgtcgaatcacatcatgcacatccatgcgaggattgaacagtgcggtgtacaccgtatcttccacggtattggcgttgatgcccaaccccaccgtggccgcaccctgcgggtcgaaatcgacgataagcacgcgacgcccatactggctcaatgcaccagcgatattgatggaactggtggtcttgccgacgccacctttctggttgcacatggcgatgatcctcgccggaccgtgcgtctgcagcggctccggagcgggaaacgtctcataatcacgtccaagcaaatccgtaggcataccgtttaccttaccaacatccttgtgtcaattttcactgtaatccatgctagtccattgtcaccgttcaaaacggcagcaacaccatcatctggcgcgcggatgagacatcagatatgtctcaatcaggttttcaggactgatatgcgtgtaaatctgtgtggtggtaacgcttgcatgaccaagcagctcctgcacggtacgcacatcggcaccgccctgaataaggtgcgtggcgaaagagtgccgcaaggtgtgaggatgcagcggcttatcgatgtgcgcacgctcccccgctcccctgatgatttcccaaaccgactgtcgcgacaatctttttcctcgtttattcagaaatagggcacgccgttccacgggacctttcgatttggattccagcttaggacgccccgcatgcaaataccggatgatcgcttcgcacgcatagctgccgacgggaaccagccgctgcttagagcctttgcccataagtcttgcgattctgccgtctacatcgacatcatcgagattcgcaccgcacgcctccgacacgcgggcaccggtcgcatacatgaattcaagcaatgccttgtcacgcaacatcaccggatcatcgggaaactccgacacgacaccatcatgctctctgttttgagaaacggggatagagtccagcagtctagccacctcatcaacggtcagcacatcgggaagcgtgctcacgcccttaggggcctttacctgcgcggacacatcattgacaacaatatgttcgttcactgcgaaacgatgaagcgcatgaatgctggccaaccggcgtgccttgcttcgagatgactctcccgactcgtcaaggaagacgatataacgttccacatcctgtgtcgtcacggccgcgataccgccaacgccttggtcggcaagccactgacgatacttcttcaaatcggcgccatacgccgacaccgtcgccttcgacagtcctcgttcaacgtcgatatgagcgaggaattgccgaattgtccgttcgaaatcgtccatcaccctccttccagcagatcccatccggctcatcgtataccactgagcggtcccttaccataggtcaaacgagccctgccatgcaacgcaggaacccccgcccattgctggagcgagggttcctgtcaatcacgctgaatcagcgaagaagctcaggcttccttcggagcattcacatcagccggaagagcggccttggcctgctcgacgatggccttgaaggtctccggatcagagatggccagctcggcgagagcgcgacgatccagttcgatgccagcgaggtgcaggccctggatgaagcggttgtaggtgatgccctcagcgcggacagcagcattgatgcgctggatccacagcttgcggaagtcgcccttgcgagccttacgatcgcggaagttgtaagtaaaggagtgaagcagctgctccttggccttacggtacagacgggagcgctggccgcggtagccggaagccctctcgagaacgacgcgacgcttcttgtgggcgtttactgcgcgcttgacacgtgccatatttgattcctcagctttctattaagtcttcttattcgctctcgctatactcagcgaccgagcagcttcttcatgttcttgctctgggaagtagccagaacgccgtcggccttcagtgcgcgacgcttacgagcggacttgtgctcgaggttgtggcgcatcgcggagccagcgtgcatcagcttgccggaaccggtcacgcggacgcgcttggaagcggcggaattagttttcatcttcggcattgctgccctccttgtttattacttcgtttcggaagtcttcggtttgtcggatgccactgcagccttggcttcggccgccgcctgagcttgggcttcctgcttggccgccagacgtgcagcctgacgggcctgacgctcggcacgggactgatcaccacgacgacgctgctcggactgggtgtgaaccttcttgcccttcggtgcgagcgtcatgatgatattgcggccttcctgcttcggagcgaattcgacggtgccgtattcctccacttcgctggcgagacgctgcaagagctcgacgccaccgatcggacgggactgctcgcgaccgcgcagcatgatggtgaccttgaccttgtctccaccgttcaggaagcgcacaacatggcccttcttgacttcgaagtcatggtcgtcgatctttagacggaagcgaatttccttgatttccgcagtgctctggttacgacgagcctcacgagccttgatcttctcgttgtacttgtacttgccgtaatcgatgagcttggcaaccggaggcttcgcgttgggcgccacctcgacgagatcgaggttcgcttcctttgccaggttcagtgcgacggaagtcgcgatgactcccacctgttcgccgttcgggccgatcagacgcacctgggagacgcgaatctcgtcgttaatgcgtggttcgtcgctgatgatgactccaatcctcatgttccattcgacggaatgctcccagatcggcagtttttcaaagtctcgcatgttcacggcaagccaaaacacccaattcgagggcgcaacaaagagccataccacagctcttccactgccgtttcatacggcaccagaggcttatgcctgaacccgaggccctgaaaggcttccaggtggagatatcccgctttcttgatttctcaagccttgtagataataccacacaccgcgaccacagcgtgtcgcataatgaaaccttctgaaacatcttctttaatcattccaacgccatattacactgaccccatatgacagataattccaacacatgcgtgattttcgcggctggcgaatactacagcgatacccccatcgttccgtctggagcattcattatcgcggcggacggagggcttgaccatgcacgcgcacttgatatgtcgcctgacgtggtggtgggcgatttcgattcgcttactggagaacgtccgacacagggtgaacacaccattgccctacctccagaaaaagacgatccagaccttctgtcggcactaaaaatcggctggtcacaccatgcgcggcttttccatatatatggcgcgctcggcggacgaatcgatcacaccatatccaatatccaactgatggcattgctggctcagcatggtgcagtaggttttctgcacgggaacggctccattgtgaccgcgatttgcgatggagcactcgatttcggcgagaacaacgtcgaaccaggacgtatggtttccgtattctcccattccgacacctctcttggcgtgagcgaacgtggactgaaatacgagatagatgacatgacgatgaccagcacacgtgtcaacggcgtcagtaacgaattcctcaacggagccgccgcccatatcggcgtcgaacatggcaccttggtggtgactttcccttcggaagccccactaccagcagtctcttggcaccacacatttgagggtgacctcggatcgttggacaccaaagtatcttcagcgcttgccaagcacgaacgccaatcccgctaatcgcaaagcgaagaaaatcacctttcgtctatcacgtttatctcgaaaagatgatgtgagcgttcacggaaaaacacgacgttttctgaaacacacgcgcgagtgcgttgccttaagtacaggtgacgcactaaagtgggtgacgttggtaaacaatggcttctgtgtgcccagcacacgcgtggcctaccctaaagggagaattacatgacagttaagattggtattaacggctttggtcgtatcggtcgcctggctttccgccgcatcttcgagctgcaggctcgtggcggccaggccggtgacattgaggtcgctgcaatcaacgatctgaccaccccgtccatgctggcctacctgctgaagtacgacagcacccacggcaccttccgtcatgacgatggcaccccggttgaggtcacctccaccgaagattccatcgtggtcgacggcaaggaatacaaggtttacgccgagaaggatgccaacaacatcccgtgggtcaagaacgatggcgttgagttcgtgctcgagtgcaccggcttctacacctccgctgagaagtcccaggctcacatcaacgctggcgccaagaaggtcctgatctccgctccggccaaggacgagaccaccccgaccgtcgtcttcggcgtgaaccacgagatcctgaaggcttccgacgtgatcgtgtccgccggctcctgcaccaccaactccatggccgccatggtcaagctgctggacgagaactggggcatcaaggctggcttcatgaccaccatccacgcctataccggcacccagatgatcctcgacggcccgcgcttcccgaaggctcgcaacaaccgtgccgccgcaatcaacaccattcctcactccaccggcgctgccaaggctatcggcaaggtcgttccgtccgtgaacggcaagctgcagggccacgcccagcgtatccaggttccggatggctccgtcaccgagctgaccaccgtcctgaacaaggaagtcaccgctgacgagatcaacgccgcattcaaggctgccttctcctccaccgacttctacggctacaacgaggatggcatcgtgtcttccgacatcatcggagacacccacggtggcgtgttcgatccgacccagaccgacgtcaacaccgttgacggcgtgaccatggctcgtaccgtttcttggtacgacaacgagtacggcttcacctgcaacatggtgcgcaccctgctgtacttcgctgagatctccgagtgaaccatggcggagcaatccgcacagttcactaagtagaacttggtacaagggctttcgtctcacggcgaaagcccttttgctaaccgacacaaatacgttttagagtgaatcgatatgggcaagaaaaagcatgagaagggcgccggctccacgccggcaacagtgcaactcgaacaagcgggaatcccattcaaaacatacgaatacgcacattcgaacgaccatatggatgacggttatggggttgaggccgccaccaaactgggcttcgatgaacatcaggtattcaaaacgcttatggccgacaccggctccgaacgtgtggtgggcgtggttccagtaagcgggcacatggatctgaaggcgctggccgcagcagtcggagccaagaaagccgctatggccgatccaaaagtcgccatgcgcgaatccgggtatgtggtgggaggcatctcaccactcggtcaacgcacgcatcacaaaaccgtgctcgacgaaagcgcgctgcaatatggcgaaatactactgtcgggaggcaaacgcggcttttcaatcggcatcaatcccaatgatctgctcaaggtgcttgacggcatagccgcacctatcggcacctggtaatcaccggtaatagaagccggtcagcaggctggtttcttacgaagctcactggggagcacgaaatgcatgttctccttaatggtttcgatggtggtcacatcatcgaaaccacgctgttccagcgcttcgataacgcctgacaccaattcgtcaggcacggatgctcccgacgaaatccccacggattcaacgccttcaaaccacgcaggatcaagctcggacgcatcatccacgcggtaggcctttccgtgaggaccattcggcacgccatcgaagcgcgtgttcagcccctcctgcgcaacctccatcagacgaacggaattcgacgaattcgccgaaccaacgatcaccacgcaatcagactgctcggcaaccaacttgaccgcggcctgccgattcgatgtggcatagcagatatcggaattcggaggcatctcaagccaggggaaacgctctttcaacgcagcgatcgtgcccgccgtctcatccacgctcaatgtggtctgcgaaagcagcaccaatttcgcatccgaagaaaactcgagcgaatcgacatccgattcatgttcgatgaggtgcacatgttccggggattcaccgaccacgccaacggcttcatcatggccgttgtgtccgatgtagatgatctcgtacccttctttgacgaaacgcaacacttcacggtgcactttgctcaccaaagggcatgtagcatcaacgatatgcatgccccgagctgaagcttcagccttcacctcaggagacacgccgtgcgcagaaaagacaatcggaattcccgcggaagccgcggcatcgggaacctcatccaattcctgtacgaacaccgcaccctgagccgacaattcctcaacgacatgcttgttgtgcacaatctgacggcgtacatacaccggcggcagaccatcattgcgagacgtattggcagctttgagaatcgtctgcacagtcagaatcgccctgtcaacgcccgcgcaaaagccacgtggatccgccagtacgatacgcttggtcatgatggccgcctttcgtcacttcgtgaaaacctcatcaatactaaagcatgggcggcacgccggagaaacggcatcgccatacggcataaaacaggtagactgtggtgttagcggtaacgctaccgttaccggaacatatccaacggcactatggagtgactatgacctgcatcaatctgcctgcccgcaccggacagcaattctccatctcccatggcgactatgaagccgtcatcaccgaactcggcgcaacaatgcgcaagctgacctataagggcgaagatctgacggtcgcccttggtccggacgatctggtgacctgctgccacggccagatcctcattccgttcccgaatcgcatcgagggtggcgagtacacgttcgaaggcaagacctattcgctgccgatcgatgagcatgaccgcaacaccgccatccacggctacggataccgctcgttctggaagctgatttcgcttgccgaagacgcagtgaccctcgcctggcgttcccccaacatggtcggctacccgtttgatctatatgtcaccgccacgtacagcctcgccgacgacggcatgcatctgaccgtcagcgcctacaataacggcgacacgaacgcgccgtgggctttggccattcacccgtggcttgccaacagcctcaacggctatggcgacgaaatcgacgagcacaacgccaagtgcagccttacgctaccggctcgcacgcatgtcaccgtagatgaaaacctcattccgaccggcaccgagccggttgacggcaccaaatacgacctgcgcgaagacaccctacttaccgagcagccgttcgacgatgcatggaccgatctggagcatgccgaagacggttccgtcacggcagtgttcacccgcgccgatggcaagaaggtccgtgttggcggcgatgaaaccatcacttcgttccaggtgtgcaccggtaccaagttccccgcattccagcatcctgccggcgttgccgtggagccacagaccgcctacgccaacgcgttcaacacaggcaacgagctgatcgtgatcaagccgggcgaaaccaccagcacctcgctgttcctcggtatggccgagtaaacatgcgagtgagcgtgatcgagtgatccagtcggttaaaccggctgattccggtcatataaaaacccgacggataagtctaagtggccacctatcgaacaccggatttggcaaacgtctcgctcgtgtgcgataatcccgaagacttattaatcgtaagtaaaggagtccaatcatgggcatgcgcggacgtaagcgcaaggatcgtcgtaagaaggccgccaatcacggcaagcgtccaaacgcctgatccctgccagcgtgaataacgctacagagcatcgaaaaccccgctgaatcgttatgatcggcggggttttctcatactctcatcggcttgctcaccgctctccacaacaatggtcgagcgttgcctcaaggcggtcgataagactctgcggggcatgctgcggacgcaaatacgcacgcatggccgcgatcaatgcccgttcacgctcgtcgcagcaacgttcggggtcgaaacaatcactggaggtgctaacgcgcacgctggtatgcgtcacctgtgtcacagtgccgtcctcgctggcggcgacagtggtgatatgccgttcgatcgattcactcatgctctgcccttccctgccgtggcatagccacgttccttcgcatagttggcaagttctcgtttcaactgcgtacgcgcgcgattgagacggctcatcaccgtaccgattttcacaccctgttcgtcagctacctgctggtatgatttgccgtcgatagcagcatcgatgaacacctgacggcgttccggcgaaagcttggcgagcgccgccatgatttcttcaggcgcgtaagcgtccaaatattcctgttccgccgatttaagctcttccggtgaatgctcggaagccgaatagatgtcccaatcgtcgtattcgccggtggaatcgttggctcgctgcggtctgcgcttggctttggcgtattggttgaagtaggcgttgcgctcgatggtcgtcatccatgcggcgaaattcgttccctcctgaaaggagtcgaacgccttgaacccccgttcgaaagtatcctgcaccaaatcttgggcgtcgtcgggatcgttggtcagcttcatcgcctgccggtacagcgcatcaaccacaggcatggcaagtttttcaaaacgcgcccttctgcttgccatggtttccgttcgtacttcagtcacagcttcattgtaatcacatcgacttccacatgccatgcacatagctgaaggtagaatggctgttcggtatccgaagaacagggagaacacgaaatatggctttgactctggcatcagcagcacgtctgctcagtgagtatggattgctgcgcgaaatcatccaaggagacgactggacgcttgacgcgcaggccgtcaacggattcgacaagccattcggttcaatcacctacgacaccaggcaggtcgtatctaacacgctcctatgctgcaaaggccgtttcaaagcggaatatctcgatggcatcgatgatcgcggtcttgccgcatacgttgcggaaaacgatttctccgcggcgacgaaagctccgggactcatcgtgaatgacgcgcgcaaagctatgagtctgctgtccgcggcattctatgggtacccgcagggccaactgaaagtcgtcggcattaccggaaccaagggaaaaaccactaccgcctacctcacgcaagccatgctcaacggctgctccggcggcaaatgcgcattgttctcctccgtcgacaattgccttgacggacatacctatgccgagtccgatttgaccaccccggagtccatggatgcgttccgtatgatgcgcgaagccgctgataacggcatggaatacctagttatggaggtttcgtcgcaggcgtacaaagtcgatcgtgttttcggacttactttcgacgtcgccgcattcctcaatatcagcccggaccatatcagccccatcgagcatccgacattcgaggattacttccactgcaaacgtcagatcgtaaagaattgtcgttccttggttctcggcacggcatgcgcacacgccgatcttattcgtcaggatgctgcaatcgccgatattcccatcaccgcgttcgctcttggcgaagcatcggccgcggatgtgaccgcatggccggaatccgccgaccatagccgattcgccattgcggtggaaggcgaacagattggatcgctcagcttgcaattggatggcgatttcaattatgcgaatgccgccgcagccattgccattgcgcatgccgttggattcgatttccatgaaaccaccgcgaaggaaacgctgcacaatatggaaccggtacgtatcgccggtcgtatggagcatttccacgatacgaagtcgaataccatcgccatcgtcgattatgcgcacaattacgcttccgtaacggcgttgctcgactatgtcgaccaacgctacggcaaggacgatcctgaagtcacgctggtcactggatccgcaggcaataaagcgtacgatcgcagatcggaaatcgtcagggccgcgcagaatcgcatcaaccatctgattctcaccttcgaagacacggatgacgagcctgtggaacacatctgccaagacatgctcggcagtgtcaccaatcccgatctggatgcgaggatcattctcgaccgtacggaagcagtggaatcgaccgtagtaatcgatcgcaaggatcccgaccgcctccatatcatccttatcatcggcaaaggcaacgagcgctggttcaaagaccacggcaagcatattcccttcgaaggcgacgaccatattgtgaaacgtatttttggacttgcctgacctgcagcaacagccaaccatcatcgagtaatcaccaaccataaggaacaatccaacaatcatgatcactcttgaattcaccgacgcagccaccatggaacagcaggctgtgcaggcgggtcttaccctgcccatcgaacagaccgcggtatgggccaaataccagaacaccattgacggacgtacgccgtggggtgcgtatgtggtgaagcaggacggcgctccaatcgcattcatcgcacttatcgattacgaaacccatggctaccactatttgaggtccgttcatggtccggcttggcttgacaagccttccgcgcagctggaagcacaggttcgtgacctgcttgttgaggacgtacgcaaacgcgataaaaacgttgtgttcctgcgtatcgacttgtggaatttcgagggctcgttcccggtgctttccaccgttccttacaacgagaccgtgtatgtggacatcaccggtggcgatgaggcgattcttacacgcatgaagaagcgtggccgccgcgacgtgcgtaaggcgttgagggagagccccgccgtttgcgccgatgagaccgcgcaggcgatggctgatttttccgaatactacgaggtcatggttgataccgccaaccgtgacggattctcccccgctccgatgagcgactatgtcgatatgatcagcaatcttggtcctgatcatgcgcgcgtattcgcggcacgtatcgacggcaaggttgtggcatggtccatcgttaccatcaacggcgatcacgcggtctattactatgcttgcatgcgtacggaaatcatgcgccagcatgttcccgacaagctgatttacgttatatgctgcacgcttggcgagcaaggttgcacagtgctcgatttgatgggcatcggcaacgatttcgcgccttcattgaagagtctgaacggattcaagacgaaattctccgaaagcatcgcacagatttccgcaggtcgtgacattccggtcaagaaggcattctatcgttcgctcacgctgctgcagtcgctgcgtcgcaaactgcgcaagtaataatcgcgccccacgacggatagcgcgaaatatcgtacgaaggaggatgcagcgaatcgatatcgccgcatcctccttcgtattgcatcacagatcgttggatcgatggaccgtcgacaacaaccgacgctccatcatcgccatgcatatatgcgattaccgcacatcttcagaagatgcagcatccgcatgctcaacttcggaagcatcagcatcttcatcttcagcaagatccggaccgacactgccgaaatcgttgatatcgaaatcaggattggcatcggattcgaaatcgagatccgcctcgtcctgatccttacgcggttccggctcaacagcctcctggaagacacgttccgacttcggcttcttcaaatcgggattgaccttctcttccagcatgagacgcgcatcgccagccgtagtgaagctaccgcaaatcagcacaccgtgaccatagccaacaccaagctcatcatcggcgtcaaccatattaacagcctcctgaatggcatccggcagttcaggaacacacgtaaccctttccgcaccaaacacgcgttcagcaaccgttttcaggtcttccgcgggcatcacacgatcacgccacgagttttcagtgacaaccacatggctcagcaatggttcgagcacgcccaaatactcttcgacctgcttgtctcccatcatggcgatcacgccgacgagttgctggaaatcgtaattttcctcaatcgcggcacgcaacgattctgccgcattcacattatgcccgccatccaaaatgatcgttggcgatgtgcgaatctgctcgatgcggcctggaatcctcaccgtgctcaacgcctcagccacaagatcaccgtcaagcgcaccgttgacgggaatcaccacttccgccgcgcacagggccgcgagcgcattatgggcctgatgttcgccgaatttggcgatcggcacttccgcgtacgtgccattcggcgtacgcagggtcgcaacctgaccgccgactgccggaatgcgggtcacaacttccgcttcgatgccatccctcaccagattggcatggttctgcctcgccgcttcctcgataatcggcatgacggcctcttcatgcggttgacgcccgatgaccgcggtgcagcccggcttgataatgccgactttttcggatgcgatctgttccacggtattgccaagccatgccatatgatccatgtcgatcggtccgataatggccgcatcggcatcgagcacgttggtggcatcccagcggccgcccataccgacctccacgatggccacatcgaccggagcgtcggcgaacttccagatggccatggcggtgagcacttcgaagaagctcatttttggcttgtcgagttcttccatcttcatgtcgaccatggctacaaggtctttgatttgatcccaggtatcaacgaaatcgtcgtcggaaagctgctggccgtcgatggcgatgcgctcgttgacatgttcaagatgcggtgacgtgtataaaccggttcgcatgccgtaggcacggcagatcgcctcggccatgcgcgcggtagatcctttgccgttggttccggtgatgtgaatcacacggaacgactgctcgggatgtcccatgatgtcgaggatcatcttcatgcgttgcaggtcaagattggtggtattgcgctctgatgggcggctcatgatgtcgcgttcgacgtcgatcatgctttcattgttgcgattcggatgttcgaatgacatattctttcggattcctcccctaccttgggattgctcactcaatctcccttattctatgtgcttgcatgaacgttgcgcggcgcaaaaagttataggatggtttgcggtaattgcgtaagcatggacaaccatattcaggagatgtgatgaacgaagtcattaccgataaagacaaggagtatgaagccatggagcagtccagcgctcccggccctgatcaggcgatgagcgaccgtgtgaacaatcgttcgctgcgcccgcgttccgaggcgttcaaggagttcatgaccaccggttgggatgataatgagccggttattgaaccgttggagtcttcccattacattcaggctcgtcttgacacgctgggtaaggcttttcccggagagcgtattgtgatcccggccggtcagccgaaggcgcgcaacaacgactgcgattatgcgttccgtccggatacgacgttttcgtattacaccggtttgggtgaagactacgaagccggtgccgtgctggtgttgaatccggttgatcccgattctccggaggctgcggccggcaagacgcatgtgccggaattgtttgtggctccgcgtgcgaaccattacacgcaggactttttcatgaatgcccattatggcgaatattgggttggacctcgtgccggcttgcaggagatgactgcaatgaccggtattgagaccaatgacattgcgcagttggctgacgcactgagcaaggatgtcggttctgaagctggtgccgtgcgtgtgcgtgtgattcgcgaggctgatccgcagatcaccgaaatggtggaggatattcgcgaggcgaacggtttcgccgatccggatggcaatacgcatgccgatgacaagcttcatgagtttgccgccgaggctcgcatgtgcaaggacgaatatgagattcgtgaaatgcgcaaggccgttgccgcaaccaagcatggtttcgacaatattctgcgcaagctgccgtcgtcgctcgacaagcctcgttcggaacgtatgctggaaggcgcgttcaatgccatttcccgtgaggaaggcaatgaggtcggctacgatacgatcatcgcttccggcgctcatgcgccgattctgcattggatgcgtaacaccggtaccgtggagtccggcgatctgctgctgattgatgccggtgtggaagtcaatagcttgtatacggccgatatcacgcgcacgttcccgaccaacgggaagttcactgatttccagaaaaagctgtatcaggcggttttggactcccagcaggctggttttgaagctgccaagccgggtgccacgtattccgacattcatcatgcgtgcatgcgtgtgatcgccgagcgtctgcatgattggggcattcttccggtcgatgtcgaggagtcgctttctccggaaggacagcagcatcgccgttggctcgcctgtggtgtggcccatcatcttggtttggatgtgcatgattgcgctcaggcacgttatgagtcgtatcagggtgctgcgattcgtcctggcatgattttcacgattgagccgggtctgtatttccgtgaggatgatctgttgattccgccggagtatcgcggcatcggcattcgcgttgaggatgatgtactgatgactgaggatggtccggaatggatttccgccggcattccaaagcagatcgatgaggtcgaagagtggatggccagcatggctgccgaaggtgcaaaggcctgatatgccaacgcctgaattcattctcgagttacgcaagaaagtcggtcacgatctcctgtggctgatgggcgtctccggctatgttgaagacgagcaaggtcgtgtgctgcttggcaggcgttccgataccggcgagtgggccatggtgtatggcattaatgagcctggcgaggaacctgccgacacggtggcgcgtgaggtcaaggaagagactggcgtggatgttatcgtcaccgatttggtgtcggtgaagtcttcccgcaaggtgcttacgtatgcgaacggcgacaacaccatgtatatggatcacctgttcgtgtgcaagcccgatccgaatggtaatgccgaaccgttcgtaggtgacgaggaaagcctcaacgtgggttggttctcccctaatgacctgcctcagcccctggccgacaccacagtggaacgcatgggctacgtgcgtgagtacctcaagaacaaggcgaacggcgacgcacacgcgcaattctccttcaacggtgcgattcgctgaatacagtcacaattgaatatataaactaggagctggtgtgacgatcatgaaccgtcacaccagctcttgtgcatgtcaggaagccacgaaactcacttcggaatcaaattcctttggcgagcaactcgtgcagctgggcgcgatgttttcgctgttcacgcggatcaggcaccggcagcgatgccaacaacttctgcgtgtagggattctgcgggttattcataacctgatcggcatcaccatgttccacaatctcgcccttatgcatcaccataatgcgatcggccagcatatcgaccacggcaagatcatgggtgatgaacaagcatgcgaaacctatttccgcctgcagtttcttgaacagctccaacaccttcgcctgtaccgacacatccaatgcagaagtcggctcgtcggcgatcagcaggctcggcttaagcgccagcgctcgtgccaaggaggcacgctgacgctgaccgccggaaagctcatgcgggaaccggttcatatatgcacgcggcaactgcaccatttcgagcagatctcccacatagtcgctcgcttccgacacagacgagtactttttatgcacgatcagcggttctgccacattctccgcgatggtcatcagcggattgaatgaactacccggatcttggaacacaaaaccaatatcagcacgcttgggtttgaattgacgttccttgacaccgttcatttccacacccaacacgttcagggagccgccggacactttctgcaaaccagcgatggcacgaccggtagtggatttgccggaaccggattcgccgaccaatcccagcacttcggaacggtgaatagtgaaatcaataccattgaccgccttgaaatcaggctgcgtcaaatgcccaggataggtgatagtcagtcccctggcctcgacggcaatgggttggtcatgccaatccttgctgcgttcaatcaccttgccctgctcatcacgaacgaccagtttctgcccgatacgcggcacggccgcgagcaaccgcttggtgtaatcgtctttcggcgagtagaagatctgttcgacgcttccctgctcgaccacatgacctcgatacatgaccaccacttcatcggcgatatcggcgatcacacccatattatgggtgataatcagcacggaagcgccgaattcgtcgcgggcaagacgcaacaagtcaagaatttctgcctgcacggtcacgtcgagtgcggtagtcggttcgtcagccagaatcagacctggattgagcaccaacgccatggcgatgacgatacgttgtttttggccgcccgagaactgatgcggatagtagtcaattcgagtttcggcatcaggaatgcctacttttttgaggatatccacggacttggcacgaagctccttcttgtctttcatgccgtgagcgcgaagtccctcttcgatttgccatccgatggtatacaccggattaagtaccgaattaggttcctggaacaccatggccgcttctgatcctcgcatacggcgcagatcttctccggaaagagacagtacgtcaagctgctcattgccttcacggttcgacagataaatcatgccggaagtggttgccgtctccggcaacagcttgataatcgaacgtgcggtcacggattttccggaacctgattcgccaaccacacccaccacggttttgcgtgggatggtgaagctaatcttgtcgatggctttgatggatcctgcgtcggtcatgaaggaaacgctcagatccttgacttgcgcaagattggtttgttcgtcactcattgcgtcactcttcttccttggagccccattcggaggcggtaaatgacgggtcgcgatccgtaacggtcactggctgatcgctggctcccattggattcttggcggccgcgagctcggctatcacctcgttgcgaacgcccggcttctggctgggatcaaccgaagtatcttcgatggatccaaccacctcaccagcggatttgcgtgcacgcagacgcgggtcggcaaggtcattgagggattcgcccaccaaggtgatacccagaacaatcaatacgatggcgatacctgggaacactgcggtccaccaaatgcccgcggttacatccgacacggaacgattcagatcgtaaccccattcagcggctgcggtaggttcgatgccgaatccgaggaagcccaatcccgcaagagtcagaatcgcttcggacgagttcaacgtcagaataaccggtaacgttctggtggagttcttaagaaggtgcttggtcatgatgcgccatgtcgacgcgcccaccacgcgagcggaatcaacgtaagcggattccttgattcgaatgacctcggatcgaatggtacggaaatactgcggaatatagaccacggtgatggagatacccgaagcgagaatgccactccacagaccagactgaccgccggaaatcataatggccatcagaatcgcaagcagcagcgaggggaaagagtagatggcgtcggcgatcatgacaagcacacgatccacccaaccaccgaaatatccggaaaccaaaccgagcaatacacccgcgaaaatagaaagcagcacagcgatcacaatcgcaatgaccgcggtacgagagccccaaatcacacggctgaacacgtcataaccacctgcggtggtaccccaaatatgctcggatgagggtgctgcctgggccgggaatgaaactccattggcatctttgagctgcgcatagccgtacggtgcaattacgggcgcgaacaaggccacgagcaggaagaacgccgtgagcaacaggccggtaatcagcatgcctttctgccagccgaccgctacgcgaagctccttgatgatcggaatcttggcccagaacggagctttcctgttgactttgagatcgttcagacgagtgtcacccgggacggtgacgttatttgctgatgcagtcatgtcagtacctcactctcggatccaccaacgcggcgataacgtcaacgatgaagttgacgacggccacgatgatggcgatcagaatcacaatgccctgcacagctacgaagtcacgcgctttcagatattgggacaacatgaatccgagtcccttccattcgaaggtggtttcggtaagcaccgcgccggcgagcatcaatgcgatctgcatgcccataacggtgatgattggaataagcgccggcctccatgcgtgcttgctgagcagacgtttttcggcgacgccacgcgaacgcgcagcctcgacatagccggaattgtaggtggaaatcacattggtgcgcaccaaacgaataaacacgcctgcggtgagcaatcccaacgccagcgcaggaagtacggcgtgacgcaacacgtcggccagcacgctcatatcacccagctgcagtgcatcgataatgtagaagccggtcggagagacgagtcgggtgaactgcatttccgaagacaacgagcatcgaccggatgccggcaacacgttcagccagatggcgaaaatgagtttcaggaccaatcccaagaagaacacgggggtggcgtagcacagaatggcaaaggttcgaatgcctgcatcggcagcgtgatcacgtctgcacgcagctacacgacctaagccgatacctacgatcaaagcaacaatgagcgataggagcgccaactcgaaagtcgctgatccgtaatgaacaagaatgctgataaccggctgattatcagtcaacgtagtgccgagatccccatggagcaaacccccaaggtaatcgatatattgcacaataagaggacggtcgtagccggccgcatgaacacgcttttgcaactcgtcaggggtaagacgaccacccaatgccgcagaaataggatcgcctgtagctcgcatcacaaaaaacacgacggtgacgagaatgaaaacggttggaataatgagcaggaatcgagtcaggacgaaacggaaaaatccgcctgacaaatgattctttttggcttgtttcggcttcgcctcctgagagacggccggagctgctgtgtctgacacgcgatgctccttgataagaagcctgtacggctttgatttacaacaatatcgaatcactgcgccgtttcaggcagataattcgggaaatggggacctccggccatagaccggggatccccagtggttttctatgcaggctgcggcaggtcatgccgcacatccgcacacatcacgccttggtgacagatgcgaaacggaaacggaaggaagcgtcgagcacaacacccttcacgttggcgccggtaactgcaacctgcgcaccctgcagcagcgggatggtggacaggtcttcggtttcaagggtctgaatcttcttgagcagatcctcacgggcgctttcgtcggtttcaccagcctgctccataatcaaatcgttgatttcggagttggagtaagcgttgttcacgaagttgccgtcacggaagaacggagacagatagttatccgggtcggagtaatccgggaaccagccgagctggtagaccgggtaggatccatcagagtcctcggtaacaacacggtctttgttgtactgggtccattcggtggactgcaggtcgaccttgaacagaccaccctcctcgagctgagccttgagagccgcatactcgtcggcggaagaggatccatagtggtccggattgtactgcagcttgagctcaaccggagtggaaacgcctgcgtcctcaagaaccttcttggccttgtcggcgctcggcttgccgttgccgtcaccatacgcggtcttgaaggtgtcttcgtgaccaactaaaccgtccggaatgtaggagtacatcggggtgtacgtgtccttatagaccttggtcgccaactcctcgcggtcgatgaggttagcgacggcctgacgcacagccttggccttgtcggcattcggttcatcggacttggtgccgtacggctggatgttgaagttgaagaccaggaagcgttcctcaccgcccggacccttgacgaccttgaccttggagtccttggacagatcatcgatgtcggtcggagtcagagaacggtaggccacgtcgacctgtccctgctgcacggccatcttcaggttggaagaatcggcaaagtacttgacctgaacagtgctgttcttggccggggtcagaccctgataagagtcgttcttggagtagcccgcaacctcattggccttgtaggaggtcagaatgtacggaccggcgaaagccttctccttgatgatggtgtcagcatcagtgagcttgtcggcggagaagacctcttcgtcgacaatcggaccggccgggctggaaagcacctgcttgagggtcacatcgttcttgactttggaatggaacaccacagtggtgtcatctggcgtatcgatggattcgatgttggccagcaacgaactcggaccattctcatcgttgatcgtgttgacacggtcgaaggagaacttgacatcggacgaagtcaggtcgtgaccattggcgaacttcaggccagacttgatcttaacggtgaactcagtgccgtcgtcactccaggtaccgtcatccgcagcgatgtccggagacagttcagaggtgttgtagtcctgcgcatacaggaacgggaacacgttgatttgaacggcataggaaccgttgtcataggagccggcagggtcaacgctagtaaccttgtccgtggtgccgacggtaatgacatccgcatcccccgatgcggaaccgctatcctttacgccgccgcatgccgcgagcgaggccagtgcggcaatcgagacagccgcagccataatcttcttgtgattcactatggaatcctttctcttcctgctgtcgtaattggtactccaaaacgacgtgccataagggtagggcacactttgttagcggaacatttcacggaagctcattttgcgacatcaccctttctcgatccaacgaaaactcagcaatcacaacggttttgcagttaatttttttccgaaaagagtgtgtcaaataatgagacagcgaatcccatattgagaatcgacggtcctcgtgacacgccgaaagacggaacttgcatcaactaattaacggcgttaatatatcaactagttcaacgaagggtccgtgcactggcgcaaggaggtgtcatgagtagttacagcgctcagcaatcatcgatttcagaaaacaatcgttccagaatcctgcaatacctctaccacaacggcatcagctcacgtgcgcaaatcgccaaagccatcgaactcacacccgcggccattacgaaaattaccgcaaaactactgttccgagacgttatcgaagaaaccggagacatggaaggcgataagaatcgtcgttccatcggcctgaatctcaattgcgcgaaataccatgtcgtcggcgtgaaattcgcacgaagcctggtgcagatcgcagtgttcgacctgaaatgcaatcgtatttccctcaccgacctgcccaccgttgacgaggagcatattcccgaaacggtagaacagatccgggccaccgtacgacagctcattgcggacgattcgagcattgtagccgtcggcatggccgttcccggtccgtatctggtggaggaaggtcgcaccgcgctcgtctcatccatgcagggttggcggcaggtcaacttcatcaaggagttcagcgaagcgttcaacgtacccgtattcgttgaacaggacgcacgcgcaggcgccttggcgcagttcctgttcaacccggaactgtccgagggatcgctcgcctactatctgcttggcgagggcatcggcctcggcatcatcgacaatggttcgatctattacggcgcgcacggcacggccaccgaaatcggacacatctccgttgacgtcaacggcaagccttgcgactgcggcaatatcgggtgcctggaacgttactgctcagccaacgcaatccacgaacggctcaacgaacagccgagcattgtgcccggatgcgaggcaatgacgcacgcgcaggcatgcaccgcgctgttcgccaaagctgcggcaggagacaaagcggccatggatctgacttccgaggtcgctcgatatatcggatatggcgcggtcaatatcatcaacgccttcaatccgacgcatatcgtactcggcgacatcatctcccaagccggacagcccttgcttgacgaggtcaaaaaagtcgttcgggaacgtaccatccccgaagtcgggcacgataccaaaatcaccttgtccaacctcccaacggacgccaccgtcagcggtgccgcggccgtggccatcaccaattttctggaacatccttcgatgttctttgacgtcgcatagcacgccacaaccaaagaaaggaacaccatgtccaagccaatcgtcatttctctcggcgaaatcctgtgggatatgctccccaccggcaagcgtgccggcggcgcacccgtcaatttcgcataccatgcgtcccagaacggcgcgaaaagcttcgccatcagcgccgtcggcaacgacgagctgggtgccgaactgctctccgacgctcacaaggccggcatcaacacgctggtgcagaccaacgaatacccgaccggcacggttgacgtggccctgaccaacggcattccggaatacaccatcgtcgaaaacgtggcttgggaccacatcaagctcaccgacgagctcgtcgaagccgtgtccaaggccgacgccgtctgcttcggcaccttgggtctgcgctcccccgaatcccacgacaccatcgtcgaactgctcaagcacaccaaggaaggcgctctgaagttcttcgacatcaacctgcgtgcgaacttctactccaacgaactcatcgaagaactgctcggctatgcgaacatcttcaagatcaacgacgaagagctgatcatgatgcgcgacatgttctccattcctgagtgcaacgacgaagaggcatgcaagtggttcatcgaccgcttcgaccttgagtacatcattctgaccggcggcgccacgttcagcaccatcaccgccaagaatggcgaggtttccacgctgctgacccctcacgtcgaggttgccgataccgttggtgcaggcgactccttctccggttccttcaccggcaagctgctgagcggcgcaccgctcaaggaagcgcatcgtgcggctgtgaacaccgccgcctacgtgtgcaccaaggaaggcggctggccaacctaccctgcggaaggcgttccggattatctcgccgaagccggcaagtaagcccagattttcctttcatcatcatcaacgaggccatgtctgccatcatggcctcgtttttcatacccatattcaatccgcaattggtgcaatcacgattgtcacgatatacgcacctcaacgaagaatgatgccatgaacgacaccagcaacaccacagacgccgcttcacaatccgatattccgcagtcagtttccgatttcgtgcggcatatcaccgacttgtgtggcggcgaacacgcaagatgggccgaaaacttcaacgcaggattcgccaatacactcaccaccaccgtgagacggcatgatgacggcacgacgtttctgctgacgggagacatacctgccatgtggctgcgcgactcctcagcgcaattccgaccatatctcgccgtagccgtagacgatcccgagctcaccgcgcttattaccgggcttgttcggcagcaattcaggttcatcaatatcgatccatacgcaaacgcgttcaacgaaacacccagcggcgctacctgggatccgaacgatcagaccgattcgttcggaccatggctgtgggaacgcaaatacgaggtggactccctgtgctaccccattcagctggcgtggctgttgtatcgcaatacaggaaccaccagccatttcgatgatgcgtttgtaagcggcatccgtcgaatccttgacgtgttcgaaaccgagcttgaccattcgaattcgcattaccgcttcttccgtccgaacgacgatccgcgcgacagcgtgcccaaccatggtgccggaggaccttttgccgtcaccggcatgacatggtccggattccgccccagcgacgacgcctgcgtctacccatatctcgtgccgtccaacatgttcgccagcgtggtcatgggatatgtgcaaaggattttcatcgacgtgcttgacgatcgtgaaatcgccggtcgtgccgcggcgctgcagcattccatcgatgatggtcttgcccatcacgcaaccatccgcaatgcggccggaaacgctatctacgcatacgaagtggacggtctcggcaacgcgttgcttatggatgacagcaatgtgccgaatcttatgtcggcaccttatctcggattctgcgaagcggacgatccgctgtatctcgaaacgcgcaatactttgctgagtcaggagaatccttactatttcgagggtgactatgcacatgccatcggttctccgcatacgccagaaggttatgtttggccgatcgccatggccatgcaaggattgacaagccacgccaaagccgaaaaagaacgtattcttgatcaacttgtcgccgccgacgccggcacgcatctcatgcatgaaagctttgacgcgaacgacccgaactcctatacccgtccgtggttcagctgggccaatatgatgttctgtgaattggtcatggattatttcggtattcacgtcaagctgtgagtggctatcagtttaagctttggcttcgctcacagcgcaagaattacggtagatgatttgcacttattgacattccatgatatcttgaaaagtccggtcttgcaccgggtgcttgataattcaagattggggatgatcggtttcgacggtgacctgttcgtcgcagggaagcgtgccgagaacgtagggtccgctcgtggatgccccctacaaaagaataagtgctaaatctaaccgcactgagttcgctctcgctgcctgagcttcgcgccaggattaaccagtgagcagccgctccgttcactccttctcgtctttggaaggatgctgagcgtcgtttagaagacttgctttgtcgactgagccacagggccggcaagggacttttactgtagatatgcccgccatcagttgtctgcgatatcgatgggagcagaaaaaccgccgcacggccagcagactacgcacgtagaagactgagggttcggttatcggaccggggttcaattccccgcatctccacgagttgaaagccgccagaaatggcggcttttcttgtatttccaacggttttcgaagattcctgggtttactcccaattacccccgatgtgccggatgttctaaaaaatgtgggcaaaaatccctcctccggcttgcttaatctcttccaaattccatctgtctaccaccctaaacagcatgcaaggtacgtttttaggtactcctcttcacaagacaacctcgtcaaatcaacatacgaagaatccagctctcccccatcacaaatcatcagaatcccaccatcaaattccgcgtgtcgacttgcattaaccgcttaagtgattaacatagttaatacatcaacctagttatcacgtcacagcagacgacgtcaaggaaggacttgatcgatgacctgcacttactctcccgaagcctacgtgttcggctccgaagaaaaccatgacctgctcgaggcggaaaccaacgagctcctgcatttcggacacaatttccccgccccgcagggtggctcctactggctggacgataccggcaatccggatctgacccaaaacatccacacgtggatcacctgccgcatggcgcacgtgtattccttggggttcctgcacggcgagccgggcgccgcagaactggttgacaaggccatcgccggcctgcgcggtccgctgcatgacgatgaaaacggcggatggtatccgtccatttccgcagacggctccacccatgaagcaggcaaggtctgctacgcccacgctttcgtgattcttgccgccacttccgccaagcttatcggccgcccggacgcggacgagctgctcgaagaggctctggcaacctacgacaagcatttctgggatgacgagatcggtctggccgtcgatacttggaacacggaattcaccgagcttgactcctatcgtggcatcaatgccaatatgcacaccaccgaagcattccttgccgttgccgatgtggccggaaacgaggaataccgcgagcgcgctggtcgtatcatcgatcatgtggtcggatgggcagccaacaataactggcgtattcctgagcatttcaccgccgattggcagccggatctcgaatgcaaccatgacaagccggatgaccagttcaagccgtacggcgccactccgggccatggcatcgagtgggcacgtctcatcacccagtatgcgttgagctccaagcagcgttccgaagaaggcaaacaccagcttatcgaagccgccgagaacctgttcgctcaggcacttgccgacgcctggaacgccgaaggcaccatcggtttggcttacaccaccgattggaacggcaagcccgttgtcaccgaccgcatgcactggacgcttgccgaatccgtgaacacctcggccacactggccaccatcaccggcaagcaggtgtacaaggattggtatgcgaccttctggaagtacattgatgaatacctgatcgaccataagaacggttcttggttccaccagctgaacaaagacaacgaggtcatcggtaccgtctggccgggcaagtccgacctgtaccatgccacgcagtgcacgctgattccgcgtctcgatcccgcggtctccgtcgctcctgcgttgaaggccaatccgaacgcctgacggcctccaataatcgaacttctccttctctcctcctattcgcgaagaaccccggtaccgcaaggcaaccggggttcttcgtatatcaacgcgactatttgatgattggacgcaacggcgcagacacgtcgacgttatgcttgtctccgatcacattcggatcattgatgattttatcgacgacagctttcttcaacttgaggccggatgaatcgccccatacgatcacacggtctcccccattgatttccgtggtgatggaatcctgggtttcggcagtcaccttggtgatggagttgcgcatcgattccggcaatgagctgaggatcttcaacgcctccttgatggaacgattgctcagacttgtttcgacatccttcacttcaatgacgggaattccttccacggaagctccgctgacggaattcaatatacgccccttgctgtcgaccgcggtcatgctgtcctcgcctgtcttgagcatcgcagcaggcttttgcgccttgatggtcacttcaagggagtcgggcagttttttcttggattgcgcggaagtgactcccggaatctccttgattttcttttccacgtcattgttcgacacgagaagaatcgattttcctgcttgctggcccgcaatatccaacacctgagactcactcacccattcgttggcgccgacaacgctaatattgccggactcgagacggaataccgatgagaagaaaaacagccataccaacgcgcctgcaacaacaatgacagcagcggaaacgcacgcgcgcatggcgacgacacgcgcgttcgccttgcgtcgttctttcagacgcgcactgaaatcaaccaccttcgggcgcgttaccacgcccaacgtgcctatggtttcctccaatgtcttcgaaacgaaatcctcgccggcaagattgcgcgcgtccacgaaatcgcctgatctcgaacgactcacgctgcctttgttgccactctcaaccgtattttcctgcgtcttcttcccggaagaagacgcgcgtcccgctccaccagcgacggaacggcctttcggctgaacctgctttccggcatcgctgtgtttccggctttggatggttctaccatgcgacgtctgattttcaggcgtcgttgcggaaccatccgaacccgtacctgaactgatgacccttcgcgtcatcagccctcacaatcccaacgatgagcctgaagggagtgcagcatcacctcgtccatctgtgtgatgtcgcctgcgccaacagtgaagatgacatcgccatgatgagcacgcatcgtcatcatctgtgccgcggtatgcatatcctccactccgcgaatccaatcctcggcaggcgtgtggtcaagcttaagcgcctcgtccacaatggtggcggagctaatcgtcggatagtcctcctgcttttcacgtgcggggaaaatgccggtgacgatcacatcatccgccttggccaatgcttcagcgaattcactcgcaaagaacatggtccgggagaacaggtgcggctggaagatcacgcgaatcaccgactgcgggtacctgcggcgcgccgcatccagcaatgccgaaatctccgtaggatgatgcgcgtaatcatcaacgacagtcacttggccgaccataccacgcacttggaaacgacgggcagctccaaggaacgacgtggcggcttgggcagcgttctcgacatcgacgcccaacaacgcggccgcaataatcgcagcggaggcattgcgcgcgttgtgaatgcctggaacggtaagcgtcaccggaaccatacgctcatgttcgcccaacaatcccgcgggcatgtgtaaggtgaaatgttcggcaccgctttgcgcgctttcgttttccgattcgatatgcacgaacgcggcaccgttcaaatcacccaacgaaaccgtatcctgcgtcgcatacacgaccgtacgcttggccgtctgcggatcgagagcacgcaataccgcaagattgccttcatcatcgccgcacatcaccaccgatttttcggcatgctgaacatgattgacaaaagccgcacgatagttttcctgcgtgccgtaatggtcgagatgatcggcttcggagttggtgacaatggcgatttccggatgatacttagcaaagctgccatcggattcgtccgcttccgccacaagaacgtcgcccttaccagcatggcctccgtcaatcgtcacaccatccttgccttggatggatccgccgatggcatagcttggatcggccagatttccctcaccggcatgggtgaggatatgggccagcatggaactggtcgtggttttgccatgagctcctgcgaccgtcaccgcacgttttgcgttcatcagcaatgcgagaatgtcgctgcggtgcacgatgcgttcgcctgcttcgtatgctgcgacgatttccggattgtcggatttgatggcgctggagaatacgacggtatgtttgccttcgacgttttctgcgcgctgcccgaattcgactgtaatgccgattccctgcagacgatcggttttggcgctgggttcacgatctgaaccgtccacttcaacgccctgttcgtgcagcatttcagcgagcacgctcatgcccgcgcctccaatgccgatgaaatgggttgcccccaaatcattcacgccttcctgcggactgaacgacgcatgggttggatcaagaacgatggtaccggcttcacgctggttgtcagacacgactgctcctcttgcatgttttttagcttgttccattatggtctcacccatggtctcgcatatggccgatcatgggtgggattttggaatgcgacgaacgcacctgccgtcgccgcagcctacttttcgtcaatcatggaaagcacgcgcttggccatgacttcggcggcatctcgaataccgtattgccaggcgttgtcgccatacttggcaagcagatccgaatcggcaagcagcttcggcacatgctgtttgacccattcggcggtgaattcgcgatcagccaccatcagaccgccttccgcatcgacgacaggctgggcgttgaatcgctgctcgccgttgccgattggcagcggaacataaatcgcggggagtcccaaagccgtcaattccgatacggtgccggccccagagcgacagataatcaggtcggcgcaagcgaatgcgagatcaatacgttccaaatacggcgcaacacgataatcgccatcattgccatggtccgggccaagctcgccaagcacctgttcgccggcgctcaccgacaccaatgaacgcacttcatcatctttgcctttcccagtcagatgaatcacctgggcgtgttccagcagctccctagcggaagccgccaccgcacggttcacgttcaccgcgcccagcgaccctccagtcaccaccaccagtggacggttcggatcgacaccgagttgcgctgcggccgattgtcttgtggcaatgcggtcatattccatgccatgggctatcgctgcgatttcggcacgcaatggcaatcccacacgctcggcttcaacacccttgcgtggcttcaagccggtttgcgcataggcggtgccaatcatggacgcccagcgagctcccaatttgttggccattccggcacgggcattctgctcatgcatcgcgatcggaatgcccatcttgtgcgctgccgcatatacgggagcggacgtgtatccgccgaagccgacaaccacctgcgcctcatgacgggtgagaatgtcacggactttggccgtttcggccttccactgcgcgggaaacttcagcgccgccatattgggcctgcgtgggaaaggaaccttctcaatggtttccagttcgaaaccggcctggggaaccaaatcgtgttccaagccgacgacagtgcccaccactgcgatatcggcgtctggttcaagctcgcgaatcacatgcgccacggcgagcagaggattgacatgacctgccgtaccaccgccggcaagaacgatatgcttctgattgctcatagtgtacgagcttagcccacggcaccccagtacgccgcgcgccataccgtcgcacacgcggatgctcacatttcatctacgtttgcacaccgcaatacgcggtagcgtatgctgcggtcgcagccgacactcagacccgctgcatctccgcttggatctgcggctgctgcttcatcatgctgatggttacgcctgcagcgcccaaacacagaatcaacgacgaaccgcccgcggacacaaacggcaatggcacacccatcaccggaaacaatcccaccacaacgccgatgttcacgaatgcctggccgacgatccacacggtaatgctggccaataccaaagtgatgtacctgtcctgcgattgcaaagccaccacgagcatgcaccatccaagcaccaagaacagcagaatgacgagagaggcgcctacaaagcccgtttcctcaccgatgatggcgaaaatgaaatcgttgtgcgcttccggcagatatccccatttttctccggaattgccgatgcccactccaagcaaacctccggaggccatggcgtatttgccatgcaccgcctgatagcagaccccctgcatgtcggatgcggagcaagtttggtatgtggccatgatgcggctgagtcggttcggactggtgataacgagtccgccaaccaaaaccgcaccgccgcatgccacgatagccaaccatttgccaggaaaatctcccaacagcaacgcggcacctgcgatcgcgaacagaatcatggccgtgccaagatccttgccgctcacaaccaacagcaatgcaagaccaagccacgcaatcaacttgagatatgccttatatggtccgactttgtttatctgcttctgcgcgtagatcagttcccgcggcagccatatgcacaacgcaagcttaacgacttcggcgggctggaaggtaaatccaaaaaggccgatccaacctttgttgccttggacatcgatgcccaagggggtaaacgtcagcgactgcaaaagcaaagcgataatcaggaagacgaaactgaatttcctgatgagctccgccggaatcatcatgcaggcaacacccacgataagtccaagaacgcagaatcccccctgtttcagtgcttgggaccacggagactgtccgttggcaatcatgtttaccgaagagctggaaaacaccatgatcacaccgaaaatggtgagaatgatcaccgcggttctgaacccatgaaaacaccaaatcggattaagcaggcttcgcagaccgacataaccatgaaaatcgtcgacctgctttccgacggcggccttctttttctgacgactactatcaacctgcctggttttaggcttttccatgctcgttcacccaacgctgagcctgctgtgcgaactggtttccacgatcggcatacgacttgaactgatccatcgacgcacatgcaggcgccatcagcaccacatcaccggattggacatactcgcccgcggcatcaaccgcccgttccataatgaccccattatccgccggatcgatgatggtcagaggaatgttgggagcgctcgtcttgaacgcatccagcatcggctgctgatccctgccgatgatgaccgcggctttgatggtatgcgcctgatcagccaccaattgctcgaaactgctgcctttggccagtcctccggcaatccacaccacggatttatcggcaaaactattgagcgaggccttggccgcatgcgcgttggtcgccttggagtcgtcaacgaaacgaatggctcccccatccgccgtagtggcggtggcgacggtctggatacggtggccacctggagtgaactgcttcagggatgcgatcgccttctccttatccgcgccaagtcccaacaccaacgccaatgcggtcaatgcgtcggcgagcaaatgcggatataccgtgccatccggctcggtcagatgtgtgaactcggcaactttggcaacctgttcaggcttgcccgcctcaccgcccgcgatgccggacatgtcgacgatccagccgtccttcacgccaatctggccatcttgcggttccgacaatgtgaatccaaccctacggcagccttccgcggtttcggctgcgaatgccagcttggtcacgcgctcatcatccgcgttgtacaccaacgccttcttggcatggtggaagaccttcgctttgtcggacgcgtaattgtcgataccgccatgccaatcaagatggtcgtcagcgatattggtgatcgcagcgcaatccaactcaagagaatcggtgaaatgcaattggaaagaactgagctcaacacacagcacatcatttgccggatcgactgcggcatgggacaccgctttgccgatattgccgacagcaggtgaggtcaaaccgcaagccgtcaacatctccgaagtcatttccgtagtggaggtcttgccattggtaccggtgatgccaatccattgcgcaggatgcccagtggcatcgcaatccacccgcagctgccaggcaagctcgacctcgctcatcaccggaatgccacgacgttgcgcttcgagaatgaacggggtcctcggattgaataccggagaagtcatcaccaagtcgacatgatcccaatcaatgtggtcgaaagagtgcagatcggcatcaggcttcttctcatccacgcccaacaccttttcggcgcgggaacccaacacctccatcatgctctggccagaaactccaagacccgccacaatcgcggtcttaccgctcatatccatatccatcatccttcgatcgtcagaacctcatacgccttaatatcacagtcatattgcgttcattcgcaacggcaacagaccgagcatcgactgtcacaagccggaacgggcaacccaatcgccatagaaaagcaccaaggcgaccagcacgaacagcagttcaatcatccagaagcgaatcacaaccttgacttcgggccatcccttcaattcgaaatgatgatggatcggagccatcttgaacacacgcttatgcgtcatcttgaaatagccgacctgaatgacatcgctcaacgtttccatgacgaacaggccgccgagaataatcgcgaggaattccgtatgcgtggcgatggacatggcagcgaacaggccgccaagcgccaacgaaccggtatctcccatgaaaattgaagccggattggagttgtaccacaggaacccgaagcatgctaccgccgcgcaagccgcgataatggtcagatcaagtggatcagataccgcgtaggtaaagccctcatgccccgatcccttaaggtggtagaactcccaaaaagcgatcaccgcatatcccatgaacgcaatcatcgaagagccagctgccaaaccgtcaagaccatcagtcagattgatggcattggtccacgcggtcatcaggaagttcacccaaatcacgaacagcacgatagccacgaccttacccgcgaattcgaaactgaagaacggctcctcaatgaagctcatgccggcctgggcactggggaaaccggaattcgtaggcagaatcaacgccagcaccgcatatatggtagccagaatgaactgaccgatgaacttgcccttaaccgtcaatccctcgctctgcttcttacgaaccttcgcgaaatcatcaataaaaccaagcaatcccatcgacaacatggcaaacagcaccagcaccgcagaccacgacggagtctcaccccgcgtgacgaagcggtacagcgccgacgagccccagcccaacacaaccgccaaattgatgaccacgccacccaacgtaggcgtgccacgcttgactagatgggatttcggaccatcctgacgtatgtattgcccataattcagcttgtgcaccaaacgaatcagcagcggggtgcccacgatcgtcacaaccagcgacaccacaattccgatgatgagcgaaatcacctgatgttctccgtttcagtcagacattcttcagataacgtcgtttattcgattattcgaatcttgccaaatattcttattctattgtgcagccagggcctgccaacgttcggccaaagcgctcaagccggaagcgtgggagcccttaagcagcaccacagcgcccggatgttccacggcgagttgcgtcaccagacgatcggcctcgtcaatgtcgtgcacccaatcaatatgggaagcacatcccgcagcggatgcaccttcagccatggcaccggccagagcgtccaaagaggcatcggatgcgctgccgaccgtcagcaacgcgtcaacgtcgccttccaccgcataccggccgatgccagcatgcaaatccttttcatccggaccaagctcaagcatggcacccaacaccgcaatacggaacggttgggtctcagcacccgccttccaacgcaacaatccgtcaagccccgccttcatggaatcgggattggcattaaacgaatcgtcgatcaaggtgaacgatgtttcaggcttgtgcaccgtggaaacagccatacgatgaggactgatggccgtgacgtcagacagcgcggacgcgacctcatccatcgacatacccaaatgcatcgctaccgaagcagccgccaacgcattcataacgttatgctgaccgcaaatgcccagagtgacctcggcatgctcgccatcaccattgtccaaaatgaagctcggatggtccaattcgtcgcaatgcacatgttgcgcgctgattgccggcttgccgtcattgttctgcggaagtccgaaccacatcacgtcgcccggagcgatggcgctcatcgcagccacatgctcgtcattcgcgttcagtacggaaagaccacctggaacaaggccacggatgatttccgatttggcttgtgcgatgcgttccggcgagccgaattcccctagatgcgcgacgccgactttcaacacgaccgcaatatccggcggcaccagcgacgtcaaattcgcgatttccccaacatgattggcacccatttccgcaaccagaaagcgagtttccgcatgtactttgagcgaagtcaacggcagtccgatttcattgttgaacgatccgaccggcgcaatcgtcggtcctatgtgcgccagcaacgccttcatgagatccttggtagtggtttttccgacggaaccggtgatgccaatcaccgtaaacggcgtttccaacgcacgccggcgttcgatattgtgcttggccaacgagcccaaggcaagcaccgtatcttccaccacgatctgaggcactccggcaccgtcgatctcatggtcgactattgcggcaacagcgccctgagcgcctaccttcgacacataatcgtggccatccacgcgttctccggcaatcgccacgaataccgatccttcaacaatctgtcgtgaatcagtgaatgtgctggtggccacaggcgtatcaatcgccgcggtgccggcaatcagccgtccctgaaccgcctgggcgatttcctccaagctcattggcatcatggtcgggctgctcactctgatttctcctctgtgttgatgtactgcatattgttcacgttgtttacgattatcactattcgacgtccgcatccgttccgatcgagactagttcagatctcgagatacacgcaatgcgcttttaatattggccttacgtacgccggccgcaagcaccatggcgatggacaatgacaacgcgctgctgtccgtctgcccgtatgcctccgtcgcttgcgctgcgagcgcatcggattcctgcgtacgacctgcgatgtgggtccgcttgccgacagtgcatccaaaccgtgcgaccgacttgacgatctcagcctcgctgagacccttgtcgtcgcagccaagcacatcaacattcaccgactgcaacgcatcgtcattcaacgtttcctcgctgagcgcaaggatcacagcggcggcgccgtcttcggcgcacacagccatcgtacgctgcacgtcaagaatcgacaatggatagttcagatcaaggaatcgttccaacgattgcgaattgccggcactaatcacgccgaccggattgccgagcatgtgcaggaaatccgcgagatccctcacaccctgttccaccgtttgcgtattgctgccagccacggcgaacaccgccagcgaatcggatgggctgcccgccatctcgctggcaagcttgcccaactgttgcgcagtcggttcggcataaatcaaaggaatctgaacgccatccgtttttcctcgcaacgcatgcggcaccaccgcaccatacgcaccaagcgcttgcacctgccgtaactgttgctcatccacctgcgtggacggcatgaacaacgctcccggccgcaccgaatcgatgtcgtcggcaatggacgtgaccgtcacttcggtagcgaacgcgggatcaaggtcaaagccatatctgctggcaagcagacccaacgtcattcgcctattcatggattcgctgaccgcgctcatctttccgcccctccgttcttcatgctcacacactcaccaagtcactggaatagcatcagttcgcggacttgacgccggcacttcgtacttctgcataaggaattcaccaatctccgcagtgaccgggcctgccgtcagaccaccataatcgccttgcggatctttcaacaccaccgtaacgacgaaacgaggattatccgcaggaataatcgcagaataatcgctgataatcgacgacagacgtccgtccgcaccggcaacttccgcggtaccggactttgccgcgacacggtaaccatccactttgacgaactgggaatagtggtcggacacggattccatggcattcatcacctgcgaggccacctgctcgtcaatcacgcgcgtcgcttcgccttcaggcttctgctcttcggaatgcccttcggcatcgctgatcgccttgatgatgcgctgcggctttttgacgcccttgttggcgatcactgcaaccgcgttcgtcaactggagcgcattggtcgtatacgcctggccgaacagcacggtgttctgggttcgcagatcccattgatcggccgaatacagcagaccatccgcttcgccgggaagaccaagcccattgtcttgtccgataccgaatttgctgatgaactcatatcgctgctcgttagacatcttctccgcggcgatgatcatgccgacattcgacgattgctcgagaatgcctgccagcgtccaatgctcatcgccgtgggtcgtcgcatcgctgtaggtctgcccgttcgtcgtaatgtggtccggcaccgtgaatttatccgatgcctggtgcaatccaagctgaatcatgcctgacatggtgaaaaccttgccgatggaaccgggttcaaacgtttcgctgacggccctggaaaccgtcattttcgcctggtcgctgccggcttcgatttcgtcgctatcggcgagcgcgagaatgtcccctgtttgtgtgtcctgcaccacggcgactccccacggtgaactatatttcgtgcagctttccttcagcaccttttcgacgtaccactgcacgtcgtggtcgatggtcagtgtgacatcggagccgttgaccgcgtcttttgattcggtcatggttccggggatttcgacgccgttgttgccttgttggtagacttggtacccgtcttcgcctgtcaacgtcttgttttccatctgttcgatgcccgctacgcctttgccttcaccgtcgacacctcccagcagtgcgcccatcagggttccgttggaatagatgcgctcgttgctgagttccgcgtagacgataccgcccagattgagtttggagatcttgcgcttaacggccggcgtcacatcttttttgagtaccgcatattggcctgttcccgaaagcatggcacccaattcggtggcgtccatgtccagtaccggagcgaggagtctagctaccgccgcagctccggtagcacctaccggcttgccatcgatctgatggcagttgtctccggtctgtttggtgcaggtcgtgggagtgaaggcctgtgcttcctcggggttgccgatgatggtgtagcgctccacgctttgcgcgagaatcgagccgttcgtgtccatgattttgccgcgccgtgccttcaaagtcacggtaatcgtgcggctttgcgccgcggcctgcgccatggttttgccattgatcaactggatgttggccaattgaataaggcaagccgtgcccatcaacgccagaatgacgccgatggccatggttttcgtaagcagtttcttgtggaaacgtgcgtaagtgcggtgaaaaggattcactgagcgtcgtctccgcttggctggtagccgttcagatcaatcgttagagcgcctttttggggcaccatgcccatttcctcggccttgctcggcagagaggcttcaagttcgtcaagcttggcctggtcatcttccacgtcttgggtcaggcgggtaatgttcgactcaatctggttcgcctcgaaggaatgctgcaccatttgggtacgcagcgttaaggatcccagaagacatccgccgaggaacaccacggcgataaccagatgcaacaatggagtgcttctggtgcgcgtccatgtgatgagctgttcgaagcctcgcttgatgctgttgccttcggcgcgcgttcctttgacgacgtgcaattcagggcgagtggtgccagcggtttcggtttggtcccggcgtcctgcgggagccgcgtttgatgcgatcgttcttggtgcggccacgttcagcccctccttccttgtcgtttcatgcttgcgtaatcattgccttggtcgaatcgttttcgccagcgttcaggaattggtctggtcagttccactgcgcgcagtcgcacagaggccgaccttggattcatggcgatttcttcctcggccgctttgatggcgcctcgcgtcagttctttgaagaacggcatcatatccgggggtattaccggcatatctgcgggcacgtcagctttcagaccttgattcataaatgttttgacggtcttgtcttccagcgaatggtacgactccaccaccaaacgtcctcccaccgcaagatggttggcgatctgcggtagcgtccccgccaatttgtcgagctcgccgttgacttcaatacgtaatgcctggaacacacgtttcgcgggatttcccgcaggacggtgcgcttgcggcacaacctcatccaccaatcggttgagctgccccgatgtggtcaatggttcgatctcacgcctacgcacgatttcgcgggctatctgcttggagaagcgttcctcaccatatgtacggaaaatgcgtaccagatcagcgaacgaatattcagcaagtatctgttcggcggtcaatggctgggtcacgtccatacgcatgtccaaaggcgcatcgtgagaataggagaatccccgctccgtctcatcaatctgcaaactcgacaatcccaaatccatgaacacggcgtttacctggtcgatcccctgatcatcaagcacttgcgcgaaatcgtcgaatgcggcgtgcacgggtatgaagcggtcggcaagaccttccatccgcattcgctgcgtggcgagcgaaagcgcctccgtgtctcgatcgatgccgatcagacgcgcttgcggactcgctttgagaaaagccgtagaatgccccgccaaaccaagcgtgcaatccaccgcaatcgaccctggcctcgccaacgccggggccaccagatccacgcagtcgcgcagcaacactggctgatgtatggtcgttacatctgtcatcagaattccaccgccggtaatacgtcatcggcaatatcggaatatccctgctcctgttcggcgagatattcctcccatgcctgcttgttccaaatctccgctcgggtccccacgccaatcaccacgatgtcgcttcccaaattcgcgtaatcgcgcaacatctgcggcacgagcacacgtccttgcttgtctggctcctgatcaaccgcgccggaaaggaacacacgcaaataatcacgtgcagccttgtttcccatggatgtgcgctggatctgcaatgcgatccggcgaaattccgattggggcaacagatagacacatcgctcctgaccacgggccatcaccatgcccggtcccagctggctgcgaaattttgcaggcaatgccatacgtcctttggcgtcgatttttggagtgtatgttcccaacagcagcggaggcagtccagccatcacaccgctcgcttgcgtcgaaccatcgtcggagaagggctcggtttcaacgctttgaaccatcgccacacctccttacatgatgcgcgggaacacctagacccaaaactctttccccactttaccccacacatcaccataaatccccacataaatggaaaaaatcagcaaatgctgaggttgattttccccacattgaacgaatggcatcaaatcaactaccgtaaattcatccttgcttcgctatgtcacactcgccctcgtcggttttcgtagaagcctcggggtacattggagtgcctaagttttgtgaggaagggattgcagatgtcgagttattccgcccagttgcgtgaagaacaacaggccgtcagccgcgcgtacggccgcttggatgatctgcgggcccaagctcgtgcccgtctcgacaccgtgcgtgctgccggctcgcacggatcgcccacgcaacgcaccgaacgcgattccttcgccaccatgtacgaggatcgcctcacccagctgcgtgccgtcgaagatcgcctggtgttcggcagactcgacgatgtccacggtgcgcacagatacatcgggcgtatcggactgtccaacgaaaaccacgagccgatcctcaccgattggcgagccgacgcggcccgtccgttctacgaagcgacgccttccaatcatggcgatatcgtaatgcgccgccatatcacactcagcttccgtgaagtggtcggcgttgaagacgaggtgctcgatgtgcactccgaccaggtcgggcaggcgtcttcggacggcactctgaccggcgaaggcgcgctgctcgcatcgttgaacgccaagcgcaccggcaagatgaccgatatcgtggcaaccatccaagccgagcaggatcgcattattcgcgccgacctcaaccaggccgtggtggtgcagggtggaccgggtaccggcaaaaccgccgtggcgctgcaccgtgcggcatatctgctctacacgcatcggcgaatgctcgaacgctccggtgtgctcgtggtcggaccgagctcaaccttcctgcattacatcgatcaggtgctcccctccctcggcgagaccggagtggtcagccgaaccatcgccgatctgatccccggcgtgatcgcgacggcgcatgacaacccgttcgccgcgaaattgaagggcgaacgtcgtatgtccaaagccatcgccaatgccgttgccgcacgagaacgcgtccccgcatcattgccgtcgatccgcatcaacggattcgcagtgcccatcgtgcgcgcggatatcgaacaggccatcaccgatgccaagcgcacgcgacagcagcacaacaaagcacgcgaaactttcgtgcatagcatgttgatcgccatgcgcaaccgttatgtggacaagcttgattacgagccggagcaggcggagctgacggatgtgatgcagcagttgcgcatgaatgacaccttgcgcaagacgttgaatctcgcatggttgccgatgaccggcgaatggcttatcgaccaactgttctgcaagccgcagcagcttcgtcgcttcgcaccatggcttgaggaacgcgatatcgaagcattggttcgccccaaagggtcgccgtttaccgtcagcgatattccgctgctggatgaagccatggaactgcttggccccgaccccaaagcggtcgcccgccaaaaggcgttggacgccaagcgcgccgaggaggagcagttcgcgcaagatacgctggctcaagctggcatcggctccggcatcgtcacttcgcagatgttggtcgacaatatcaacgggatggacgcggaactcaccgcgcagcgcgccgccgcagaccgtgaatggacatatgggcatatcgttgtcgatgaagctcaggaactcaccgccatggattggcgcatgctcatccgccgttgcccgtcgcgttcgttcaccattgtgggcgatgttgcgcaaacctccgcattgggcggcacccgttcgtggcgacgtatgatggatccgttgttcggaccccacaattggcaactcaacgaattgacgattaattaccgcaatccgaaggaagtgtcgcagctcgcctgtgatttcgcagcaacggagggattgtacatctccaccgtcaatgcggtgcgcggcgtgccggattcggtcaagcgcctcactctggccgacgacagtctgattgccgatgccgtggcgcagcagaccgtcgatctggtccgcgcattcgtctcctccgatggcaccggacgcgtggccatcatcgcacctgacgatatggtcaagccgttgcgcaggcgggtgtacgaacagcttcgcgaaacgttgacggcgaaggagttcgaccgtctcgatgcgcagagctcttgggatgaacaggtcaccgtttgttccacgcaaatggtgaaaggcttggaatacgacgcagtgatggtggtgcagccgggaagcatcgaggagaatgccccctcacgcattgtggccgcagccgatttatacgtcgccatgaccagaccgacacaacgtctgcttatagtccggacaaatgcagacgaaaaactgctcaagctataaggtgggaaccatgcctaaagcattgttacttgaaaatattcatcctgacgcggcacagtcactgcgtgaccacggcttcgaagtcgagtgcctcaggggcgccctcaacgaagatgaactcatcgacgccttggaagacgttgatctgctgggcattcgctccaaaaccagcgtgaccagcaaagtcatcgacgcacgtccgacgctcacggccgtcggctgcttctgcatcggcaccaatcaggtcgatctcgactatgcgggcaagcacggcatcgccgtgttcaatgccccatattccaacactcgctccgtggtggaactggttatcggcgacatcatttgcctgatgcgccgcattcctgcgcacacccatcatatgaagcacggtatgtgggacaagtctgcttccggctctcatgaagtgcggggcaagacgctcggcatcatcggctacggcaatataggatctcagctttccgtcatcgccgaggcacttggcatgcgcgtggtgttctacgacattgaagagaagcttgccatgggcaatgcccatcgttgctccacgctgaacgaactgctcgaacagtccgatgtggtcacactgcatgtcgatggccgcaagtccaataccggtttcttcggtgaggaccagttcgcgcatatgaagcaggattcgatcttcatcaatctttcccgcggttttgtggctgatttggacgctctgaagaagcatttggactccggccacctttcgggcgccgcagtggatgtgttccctgtcgagccgaagaagagcggcgacgagtttttgacgagccttgcggatgaagacaatatgattctgaccccgcatattggcgggtctacgcttgaagcccagaagtccatcggacagttcgtctcacagcgtcttgaggattattggttcaggggatccaccatgttgtccgtgaatcttccgcagatcacactgtctgatattcgttcgaacttccgcatcgcgcatcttcacgcgaatttgcctggcgtacttgccaaggtgaaccgtgtgctcggagaagagaatatcaacatcgcggcacaggcactgggcaccgaaggcgaaatcggctatgtggtcaccgatgtggcccagcgccccagccagaaggctttggacgaactcgcagccatcgaaggcacgatccgtatgcgtgtgatcagctgacgatcccaatccggcaaacgccactacgatacgaatgcattgtgggggttccaatcacttattggctggaacccccacaatgtatgaaccctaatgccgtttgccgtaatcgcccagttttgcgctaccaagtccatttcagccaaaacaaacgcattatcatatgcgttcgcaaccgtccgaacctacttcagcgcatcggccttcagctcgtcgatcgcgttctggaaatcctcaagattctcaaaattctggtatacactggcgaatcgcatatacgcgacctcatcaagatcacgcaacggtttcaaaatggccctgccgacctcgtcggatttgacttgagccagtccccgggcacgaagatcctcttcgacctgctggccaagagccttcaaatcgtcttccttgatcggacggccctggcatgccttgcgaacaccagaaatcaccttgttcctatcgaactgctcaacgttgccggaacgcttcaccaccaacaacatagtggtctctagcgtggtgaaacgcttggagcatttcgggcattcacgcctacggcggatggaatggccgtcatcgctgatgcgggtatcgaccaccttggtatctggattctgacaaaaagggcaatgcatggtgtcaagaatagcctgaaccattgaactaggccaatcttgcgcgggttcatacctcgtcgggaacgataagtctttgaccggcccgaagcgatactgaatccagattattcagtcgtaccagctcgtccacagtatccgcaacattgccaccatcaggcgtaatacgcgcagcgtacccccacaacgtatcgcccggctggacggtatataccaccaccggcgtcgctccgggatctgactgcgcgcgtgcaggcatcatcaatccagccatacaccatgcgagcaccatcagcatcatgatcacggccagtcgatccgcccagactttgaaatcaacgccatgagccttcggcacacgatccatcacgccactccttctcgaacagctgttctatcgaacgcatgttctgaatatggcacaaatgttcgataattgcagacacacctcgaacagatgtttgattttctcggcgtttcgcgttatgcttgcctaagacctgaaaggagcccaccgtgagcaccgtcccattcacgcccaaaaaggatgccgagcgtccggatgaaagcacgctgaccgaccgtcagcgcaaggtgcttggcgccatcaaaaaacatctcgtcgagcaggggttcgctccctcattccgcgaaatcggcgaagccgcagggcttaaaagtccgtcatccgtcaaacaccagttgcaagtgcttgacgacaagggcttcattcgcatgaacgcgaacaagggcagggccatcgaagtcgtgagtttcgacgatgacgaggtttcgcccggcaaagtagcgcaggtcatcccattcccgagccaatctgattccagcggatccatcatggcttcccgcgatgtccccttggtgggacgcatcgcggcaggcgtgcccatcaccgccgagcagcatgtggacgatgtgatgcgtctgccggaacgtctcactggcaccggcaatctgtttatgcttgaagtacatggcgactccatgattgacgcggctatctgcgatggtgattttgtggtggtacgcgagcagaacaccgcggaaaatggagatattgtggcggcgctgctcgacgatgaagccacggtgaaaacgttccgcaaggatcatggccatgtctggctcattccgcacaatcccgcctactcccctatcgatggcacgcatgctgagatcatgggcaaggtggtcaccgtgctccgcaaaatctgatgttagactattcaacgccattgaaatcgcgcccacaaagatgaagccataaacaaagactccatctttgtgggcgcgattcttttccggtaaacgcaccggtcatttaagaatgtttaggaatgcatttcagatttgcttgtcgaactgtatccttccggttcgagttggaaggtggtatgaggtacggatacggggaaatgttcgcgcaggcaatcttgtagttgtgcgagtatttccgccgcttctttcatggtgagtccttgttcgaccacaacatgcgccatgaagatcggcatgcctgtggatacgatgctcgcgtggatgtcgtgtaccgccacaacatgcggcacttgttccaagtgggaacgcacttcatcgagatcaagaccgttgggggtttcttcgagaagcacgcgaaccgcgttgcgcaacagtttgatggctcgcgggatcatcatgagtgcgatgatgccacctgccacagcgtcgaatccggcccagccggtgcagatgagcacgcttgccgatacgattacggcaacggaccctaaagcgtcattcatgacttcaaggaatgccgctttcatgttcatgttgtcttcgctttgcgatgcgaggataaagattgatccgatattggccgcgaggccgagtatgcccatgaagagcagcaatcgcacgtcgtttacttcgtcggcagatccgccgaaaagtctcatgccggcttccacaagcgcatagatacctacgatgaggaggatgagggctccgactgccgctgttagcacttcgagccttgcccagccccaggtgcgtttgttgctgggcttgcgttgcatcagtattgcggtgacggttgatgcgatgagtacggacatgtcggtgagcatgtgtccggcatcaacgagcagtgccaacgattctgtgatgaccgcgctgatgacttccgctatgaataccgtcgaggtgagaccgagcgacatcatgagccgtttttgatgttccgcccctgtgttcgctatcgatccgtgcgcgtggtcatgtgccatatgcttaatctttcagcccgattaagaaacttattgaaattgtttctcaataccattttcattgctctcaaaacgcaagaaaccccagccatagaccggggtttcctttatttctttttgcagtctaacgactgatcaatcgcctgtcaatacccaagcaaccaaaaagcggtaacgcagctggcactccgttaccgccagaaaacaataaaaaacgcggtaacgcatgtgacagcaaggcgcacggaatgaaggcgtacagaggtacgtcgaattccgtgtaacgcagctggcactccgttaccgcgttttttatcagaagccgaactgggcagcggtttccttcagcgtctctgcggaacgcgtaagggctgcaagctcgcggtcggacaccggggtgttgatggcggtgttgacgccggaacggttgaggagggtcggcacggacatgcagacgtcggagatgccgtggaagtcgtggagcatggagctcaccggcaggatgcggttggagtcgcgcatgacggcttcgatgatgtcaacgccggacatgccgatggcgtagttggttgcgcccttgccgttgatgatcttgtaggcggcgttcttgacgtcctggtggatctgctcacgaacttcggcgtcgagcggagcgtgacccggcagcggggtccagtcgcacatcgggacgccaccgatggtggcggaggcccacagcggcacttcggagtcgccgtgttcgccagcaatgtaggcgtgcacgttcttgacgttgacgccggtctgctgggcgatcaggaagcgcagacgtgcggagtcaaggttggtaccggagccgaagacctggtttgccggcaggccggagatcttctgggcaacatgggttgcgatatcaaccgggttggtgatgagcatgtagatggcgttcggagcgaccttcacgaggccaggaatgatggccttgagaatgttgatggtggcaccgaccagttcgagacgggactgacccggcttctgacgcggacctgcggtgatgacgatcatgtcggcgtcgcggcagatttccggatcatcggagcctgcgatggacacggtcgggaagaagctggagccgtgctgcatgtcgagtacttcggcttcgacgcgttccttggcaatgtcttcgagcacgatctcacgtgcgacgccacgctgagcggcagcgaaagcgagagtggagccgactgcaccggcaccgatgatagcgagctttgtgggcttgattggtgaatccaccatgtgcttacctctcttataagaaagaatgtcccgctggtagcaggttttctcttagaatttcatctttactttatccacacagcatgacgtttcaaggcgttataacacgacttgcaaataatgaaaagtgatatgcatcacaaaagatgtgagcgctcacaaacgctgtgtccgctgcgttgcactgttttgcaaggttttcagccgattgactgttccacgatttgcgcagccaaatgatcgtccacttccgcttcgagcatcataccgtcgtcacggtattcgacgttgatcactttgccgtattcacgtacgcgcgacaccagcgaaccggcagtgtatggcagcaacgcctcgacatgcacgttcggcgtcggcagcatggattccacctgcatacgcagctcgtcgacgccttcgccggaaaacgccgatacgatgtacgcttccggcatcaacgcctcgatacgctcgcgtgtggcctcatccatacggtcggccttgttgaacacgataatcgtgggaatggtttcgacgccgtcgatgtcggaaagcacatcgtcgaccgcgtcgatttgcgagaacgggtccggatgcgagccgtccaccacatgcacgatcagatcggcttcggaaacctcctccagcgtggatttgaacgcttcaatcagctgcgtaggcagtcgacgcacgaacccgacggtatcgacgtacgcatattgacgtccatctttggcacgcgccctgcgcactgcggtgtccaatgtggcgaacagcgcgttctccaccaattccgctgatccggtcaaccgattcgtcaacgacgatttgcccgcgttcgtatatccaaccacggcaacggtcggcaatccgaaacgacggcgagcgccacgtttgacgtcacgcgcgggagccatctgttcgatctgtttgcggagtttggcgatgcggcttcggatcacacggcggtccatttcgattttcgtttcgccaggtcctcgcgagccgatgcccgcgtctcctgcggcgcggccgcctgcctgtcgcgacagtgatccgccccagcctcgcagtcgtggcagcatgtactggagttgtgccagttccacttgggctttgccttcgcgtgaggtcgcatgttgggcgaaaatgtcgaggatcacggcagtgcgatccacgaccttcactttggtggcgtcttccaaggcgcggcgttggcttggcggcaggtcgtcgtccacaacgatggtgtcggcttcctcttgcgccacgattccggcgagttcgcgggctttgccggagccaacgtatgtagctgcgtccggcttaatacgatgctgcagcaggccgtcgcataccacggcgccggcggtttcggcgagcgcggcaagttctctcaatgattcttcggcctgtgcctgtgtggtttcacggctggaccacacgccgacgagcacgacgcgttcgaggcggacttttcggtattcgacttcggtgacgtcttgcatttcgccgagtccggacacgtgcttcaacgcattgcgggattcgcgttcctgccattgttcgtcatgggattcgttgaaatggttctcgccgttggtatcaagcagcacttcggactggtcggcgagcacgcctgacacgtcgttggcgctcatgctatgctcgatgtcgttttcttggctcaatggcacctctcacggttaaactatggtgtctttattatcatcattctctagagacatgggtatcgggcattcgccacgtggatgagcgtggcttgcgtgatgccggaggcgagcgtttgcaaggagtggatatggcacaggccgaacagtatttcgcggctgatccgcagtcgaaggatgtacgtaagaggctgcatgttgtgttgcgaggcaatgaggccgatgttgaggtttccaatggcgtgttttccggcaatcgcgtggatttgggaacgtccgtgctgcttcgtcaggctccggagcctcctgaggagggtacgttccttgatctgggttgcggttggggtccgattgcgttgacacttggttttgcttcgccgaaggctgatatttgggcgttggacgtgaatgaacgcgcgttggatctgacgcgtcgcaatgccgagctcaatggtgtggggaacgttcatgcggtcaccgccgatgagatcccttcggatgtgacgtttgatctgatttggtcgaatccgccgattcgtgtcggcaaggatgtgctgcatgagttgttgatgacgtggctgccgcgtttgaatgcgggtggtaccgcctatttggtggtgcagaagaatttggggtcggattcgttgattccgtggcttgccacgcagcttggcgatggttatgaggtaagtaagtacgcgagttcgaagggcttccgcgttatcgaggttatgaaggcatgaaattcgaatatccttcccaactgccggtttccgctgcacgtagcgatattgccgaggcggtgaagtcgagccaagtcgtgattgtgtctggtcagacgggttccggtaagaccacgcagctgccgaagattctgttggaattgggccgtggatcgcatggcaggcagattgtgcacacgcagccgcgtaggctggccgctcgtaccgtggccgaacgtatcgccgcggagatgggcgtgcgtttgggcgacgaggtcggctatcaggtgcgtttcaccgatgagagctcaccgaagacccgtctccgcgtggtgaccgacggtattctgttggcgcagattcaacgcgatccgaaactgatgcaatacgatacggtcgttatcgacgaggcgcacgaacgtagtctcaatattgactttctgctcggttatttgactgcgctattgccgaaacgacgtgacctgaaattggtaatcacgtcggcgacgattgattcggtgaagttccaggagcatttcgagcacgctttgcatacgaaagtgccggttatcgaggtttcgggacgaacctaccccgtgcaggtcgtgtatgagccgctgggcaccgctccggcgttgatgcgttccgtacccggttttgaaacgggcgcgatgccgggcgatgccgactatgaaacgttgtcggccgctcccgacgcgaaggattcccatgagccgaacgttgacatgccgacggcggtggcgcgcgcctgtgccgagttggtgattcattcgagtcatgaccgtggcccgcgcgatattctcgtgttcgcttcgggcgagcgcgacattcatgattttgagaatgcgctgcgccatcattatggtccgcgtgccattgatatgcgtcgtcctgatgcgattgagatcgtgccgttgttcgcgcggttgtcctccaaggagcagcatcgcgtgtttgagccgcatgaccatcagcgtattgtgatcgctacgaatgtggccgaaacgtcgttgacggtgccgggcattcgttatgtggtcgaccctggcaccgctcgtatttcacgttattcgaagagcgcgaaagtgcaacggcttccgattgaaccgatcagtcaggcgagcgcgaaccaacgttcgggtcgttgcggccgtattgccgatggtattgcgattcgcttgtattctcgcgaggatttcgagacgcgcccggaattcacggagcctgagattctgcgcacgtcgttgggtgcggtcgtattgcatatgctgtcggtgggtgtggctcgtaccgcgcaggatgttacggatttcggctttatcgatccgcctgatatgaaggcggtgtctgatggtttcaatgagttgaccgagttgaaggccgtggcgcgcaagcatggcgaggttgtgctgacgcatacaggtcgcatgcttgcacgcattccgatcgacgtgcgtttgggccgtatgatcatcgaggctgcgaagtcgaccacgccgaacacgttggccgcagtgctggtggtggtcgcgttcctaagtttgcaggatccccgcgaacgtccggatgagaatcgtgaggaggccgaccgcattcataaccggtatgccgatccgtccagtgattttctgaccgcgttgaacttgtgggatcgcgtgttccaagctgatggcgagccgagcaattccgcgcttcgtaggatttgcaagactgagtatttgagttggctgcgcatccgtcagtggaaggatctggtcacgcagttgcgtgagatgtgcaaggaattcaagttcaaggttggcgatccgattccggcttcgcgtccgccgcttgagattcgtcagcttccgtcgaatcagcaggctgcgcattcgttgtgttgttcgtgggatgcgcagggtattcatacgtcgatgctttcgggcttgttgtcgatgatgggcatgcagatcgtgcgtgaaccgaaggcatctgatttcgctggcttgaagggcgctgcccgtgcgcgtgccatgaagcgtgcgcagaagatggcgaagaatgattatcagggtgcgcgtggcacgcatttcgcattgttcccggcttccgcggtcgccaagtcgacaccgcaatgggtgatgagcacggagttggtggaaacgagccgcttgtgggcgcgatattccgcccagatcgatcctgcttgggctgaaccgttggcgggttcgttgacgcgaaccacgtatgcggatccgcattggtctggttcgcgtggctccgcggtggcgagcgcgaaggtactgttgtatggtttgccgatagtgcaggatcgtacggtgcagtggggtcgtatcagtccgctggaggcccgtgattttctgattcgtcagggtttggtcgagggcgatattcagcagcggttctcgtatgacgatttcattgcgaagaatcgcgatgtgctggaggacgccgccgacgatgcgagtcgcacacgtcagatggcgcaggcggtcagtgatgaggatctgttcgatttttataattcggtgattcccaatactgtcacgtcggttgcggatcttgcgaaatggtggaagtcaaagcatgatgagcagccggatttgttggattttgatccggagaaggtggagcgtcttgctgatgccgagtcagtgtcgttggctgattatccggatcattggcatacgttgggtacggacggctcccctatcgatttgcggttgagttatgtgtatgatccgcatgatccaaacgatggcgtgaccgtgcatgtgccgttgaaggtgttgtctcgtttgacaccggaacagttcacgtggaatgttcccggattgctggatgagttgattgtcggcatgatcaagtcgttgccgaagacgttgcgcgtgcagtttgttcccgctcctgatacggctcataagattcgtgcgtggattgatgagaggtatccggatctgcctggttccggtaaccagcagaagccgaatcttgctcctaccaatgcggagggtgtggccgcgtggccggatttgcctcatacgttcacgcaggcggcaatcagcatcgttggcgcgcagattcaccctgaagtgttgactggtgaattgtggagcaagctcacgccgtatttgcgcgtgacgttctctgtggagcagcagttgcctccgagtcgcaagagtcagcatggcaggcgtcatgcgcggggccctgtcaaggtgcttggctcgggcaaatcgttggtggagttgcagcgcaagtttgcggagcaagccgaggcttccgcacggcagatggtaaagaagcaggcggaaaacgctggaaatcagggcaagcttgtggagcaggccaatctgctgcataaggctggtgccactaccgaagctcgttccaccatgctgtggcgcggtgcacttgatgttttgcgtatgccgagcgagcgtatttcgtcgcgttggttgggtgcggaggcgttgatgttggcgtccgcaccatatcagtccacgaaggatcttactgaggatctgcagttggctgcggtgaagcgtttgctgccgaatgttgacgaattgccggatgatgaggcgttggcgaatgcggtgcttgatgtgcgtgaagtgttcgaagataccgtgtatgcggttgcgcatgatgtgatcgctattttgaagcggtatgcggaggttgataaagccgtgtcaggcaaggccgatctgccgatgttgagcgttttgcagtcgattcgtgagcatatcgccacgctggtgtatccgggattcatcggcaagactcccccggatgcgttagcgtcgattgaacggtatctgcatgctgacgtgcttcgtttaggtaaggcgaagaacgacaagaatcgtgatgtgcgttgggcttgggaggctgatgaggccaagcagttggccgacaaggccatggcgaaggccgaacgtgagcctgcaggtccgcgtcatgaggcgttgatgaagcaggcggtcaccgcacgttggatgcttgaggaattctacgtatcattgtgggcgcaggaactcggcacgccgaagccgatcagcctgcagcgcatcaagaaagcgttgagctaacgcatcatcatctttcgcattccattgccgtcgatactggcggttttccagtatcgacggcaatgggacctaatgaaatcatcctcagccgaaccatggttagcacactctagcgttgcttgaagaaacggaacaactgcgtttcacgtatcgtcataccgacgagcacgcttgataccatcactccagcgaatatcgcacatggcgcgcgcatcgcacccaaccatacggtcattgaatcggcgatgctcatgcgaacgcaatacgcgcccaacagcgcggccgaagaggcacacgccaaaccgctccaaatcaacgtttccacagcgatttccagcaattgcgcacctttggactgccctgaatgcaatgcgccagcatattccaatctacgacgacgcacgccgaacgcgccgagcaccagccccacagccaatcccagccacggcatccaacgagtcatacgctgcccgtacgaagcctgcgcatcgtaatgcgaatcgaaactcttattcacctgcgtcacgccagcattggatgacgaacccgacgcaaccagcgtggaaaacaacacatcctccgtctgcccgctttgcggccactgtctgacccaacattcgtcgaacgtgccattcgacgcggatacaggcacaaggagagcgtaggcgaatcgcgtgtcacgaccatcgttcggccaatcaaacacgcctgcgacgctcatcgttccctgttcggtctgcattacactgcctttggtgagaccaaaatccttggccacgtcggtagatacccacacgccggacacatcggttttcgtgttcctggcgatcatcctgatcatgcctggcgtcacttcatacgacgatatatccttgccgggcgtggcaagcggcacaatctgttgaccggcacgcatcgcaccggccaaggtgcccatcacaccgccgccagcgtcggcgagcctgtcacatgcggctccgtccaccgttcccccaacgatggcgccaacgtcggcataggcgttgatgcgttgtagcacctcggtttcgagccccaccacattggcggcctcatatccgccgagcaatgtagacgcgaacaataccgctgcaaacataagcagcgcatgactcactcccgcgccaatattgcgcaacgcttcggaaagcaccgatcgtaatcgcataatcgcctactcgcaggtgagattgttaagtccgctgccgatttccacattggagatcgaagcgatgtctccgctgtcggcttgcacgaggctcacgccaagttcgcctcccacgatcgacactttcacgggagtgttgccatgattgttggatgtgggcacgatgcagccggttgaaccgttgatgccgaataccgcaccggctggaacgcgcagcactcgcatccgttcgctcaaggccagagtggcgtccaatcccgcttttttggattccacgtccacggattggtagctgtcgttcgcttcgacttgttgcaggaacccggcatccgtgatttcagtagtattggctggcaatgttcccgtaatgccgaatatcgtcaacgtgcggtcctgcgcggatgcggtgccgtttttgatggtgagtttcgtcaatgatccggggattttgccgattgcggtgccgcccgtcaccatggatccggcggttgcgctccactcgtcaacggcgacttcgtgttcgggaatccacaatgtgtcggccaatgacaacgatccatccgacgtattgccgttgtcggccatcaactgcttccacccgtccgatgtggcccgccaataggtatccgatccgggaacgctgttgtagccaagtaagctgagttcattattcagggcgagcacatcgccgccgatgtctccggtcttcaaatcgcgatacaagggggttgcggtgttcaacgccactaccgtgcgatcgttcacctgataggcacctttgcctgaggtcaggccgttgccggaccagtccgcggtgaccaggccactcgcattgccgaaaagatcacggtcactggaaatggtgggcaccacggtaacttgttgcgtacccgcgtattcctgtacgctggcgggaaccacagtcctctcccccgccgaactgagcaatgtcggagtgcggtcaggcagccacaatgcgcaggatccgaccgcaatacaggctgccgtgacagccgccagcaaagtccaagtcacagcagtgcacttcgaacgcttccctcccgtcctttgcttcattccgaatcgtcgcgtcatactcacatataccccttcaatcacgaccaacaagcaccatcagcgaatacatcaccatgattcccctggaatcacttaccttctcaccacaactgttccgtatcgtcggtcgcatatcccacgttgtagccgttcgacacaaggcaactgcgcacttgcaggttctgcatgtcaaacgaagtgttgccatccgttccggaaaactccttgttgaaccggcttacggtatagtccttcggcacgagcgagtctctatgcaaacaatcgaccacggcttgcgcttgatcggcatacagattcggattgcctacgataatgccgtacacatcctgcacatctgcaacatactcatcgccgcattccgtggaatcatcggaatatcgggattcctgaatggtcgtcccctgtttgtgtccagcttcggcatagagtccgctcggatatttgatgagtttgatttccttatatcctttgtcaatcatgcactgccggtaatcggaccaggctttctcataatccgacgtcgaaatctcacccgtacttttggctttgtccaatatcgttttctgcgattcagcgatattaccttgcgattcccgctgttcgatccattcgctcaacgacgccgccaatttctgtccgcccgccgacccattttcggatgatgattccgatgtggcagaatcagaagacgcgcctgtggcatccccattaattgagcatcccgccaaaagcattgacaatgcgacggcaagaacgcaagtcttgcaaaatgacatccaagaagtcaccatcttcacccccgtactaatgtgtcacaacgagtgtagcaccgcatgataatgtgcatagcaggcggcatttccgaaaaacttacttgcatatacgcaaatgaggtagggtggatgttgcgtggttgcgattaggggactacaaatgattggcaagggtgcgtcggtaaggtgattgcctcgtgaaaggttggctatgcgcgttgcggttgaggggttggctcatcgatttgagggaaccgatctgctgttcgagaatttgagtttcgtggccgaacctggtgtaaccattgcgatatgcggcccgtcgggatgcggcaagtcaacattgctgtcgattcttgcaggatgggagcagccttacgctggcacggtgacgagagaaggtgtggatcgtgttggatgggtgtttcagaatccgtatggtgttgcggaacgcacggcgctcgaccatgtggtgtttccactgctcgccaagggaatgagccgccgcgaagcggaaccgaaggctttggaagcgatggaactgttcgatctgggatatgcggcggacaggcgtttctgcgatttgtctggaggcgaggcgcagcgtcttatgctctcgcgtgcggtatgttccaggccgaacatgctgctggttgatgagccgaccgcccagttggatacgcgtacatcgcattccgtaagccatgtgctcggcaatctggccggtcaaggcatgatcgtgctggtggcaacccatgatccggacacgcgggacgcctgcgatcgcgtaatcgatctagccgactacgctccgcaagtcggcgggtctactgcccagcccgccaacatcgcagtccactaatcgttttccgcaatctcaacgaattacagataaaacttctataactttgccgctttcagaaaccgctcgttcaaacccgaccaaatgccatcaggcttgctgtttggcgtagaaatcgcgttctcgagctgcgaacgggcgcagcagggttgtggtgccaaccgcacacagcaggaagatcgcgcccacagggccaagccacatcagtcccaaatgggcgttgaccagtccaccaaccgcggagccgaccgcgatgccgatgttgaacgacatggaattgagcgatgcggccagattcagcgatcccggatgcgactgagaggcaacatccatatatagcacctgcgaggcggaattctgcagatacatgaacatgccaagcaccaccagcagcaacgcaccatacaccggcacccaatgcgttacgatcagcgatgccatgagcacggcgtgcgcgcagtagatcggacgaatatgcgtcagtggttccactcccctgccacggtcggcaagcttgccgccatacaggttgctccacaggcaggccgcgccgaaaatcaccaggccgacgcttaaatactgttcgggaacatgcacttcgtctcgcatgatcggcgtcagatacgtatagaacacgtaagttgccgccgcgccaaacaccacggcaagcacgcccaactgaatacgacggtcgaaaaacaggcggaactgcggcagaaaaccaatcttcacaatacggctgttgcgcggcaacaccatcaccatgagcacaataagcaccactgtgagcacgttcaccaaatggaacgcccaacgccagccgaacgtgttcgcaacccacgtgccaaccggcacacccaccacggatgcgatggagaagccggaaaacacccatgcgatgaacttcgtgcggtactgttcagttgttacatcgggcgcgtacgtcatggcaatggccaccagcgtgccggacaccagcgcgatgagaattcgcgccaccacgagcacgccataattcgacgcgaacgcgcacagcacgttgccgataagaaacaccccaaccagcgtcagatgcgtggcaaaacgcggaaaacgagccgacagcgccgatccgagcggcgtgaccggcgcatacacgaacgcgaacagcgacacaagattgccgaccgtcacctccgacaccttcaagccagccgcgatatccggcagaacgccaacgacaatgaactcgctcatgcccagcatgaaactcagcgagatcagcaccatcacaggcagattgaaaaaccgttccttcgccacatcactcttcgccatacacttctcctccatagcccctcgaactccccacgcctcgccaaactcgcattgtcattaaagcttctcacgtcaatcgattgacgaatcaatcgtcaaacaaacgataagccaaacgcgatacaatgacgcgcgatgacacgcaaaacaaccaccacagcaaaaaacaaccgcaaacccaagaaaaacaagcagccaagcctcaccaaactccgtaacgcctggaaaaaagcaaacaccccaaaacgcatcctcatagtcggcgaaacactgatagccagtatcgtcgcgctcgcgttgatcgttggattggtgcgattcgtcggttggcgtgtgcaagtggatgaagcggtcgcatcgcaggaacaattgcagacgcaatacgatttcaatccgggcaacatcatttcagatggtctgttcttcaacgggaacgcgttgagcgagcagcaggtgaacgccatcatcgaaaaacagggtgccgcatgcagcggcgagaaatgcttgaaatccatgacgtttagcaccgaatcgcaacccgccaacgaatactgcgaagcatatgagggagagccgaacgaaagcgccgcggcgatcatctacaagtcgggaaaggcgtgcgacatcagtcaaaaagtgctgctcaccgtgctgcaaaaggagcagcatctgcttaccgccaccgatccaagcgacttccaattcaagtcggccatgggattgagctgcccggacgacgcgaactgtgacccggaatatgcaggttttttcaaacaggtgtatggcgcggcgaaacgctaccagtattacgtgcaacatgaggatcgctatggataccatgcgggcacgctcaactatattcaatacaatccggacgccagctgcggtggcagcaacgtgtacatcgaaaacaaggcgacagcactgctgtacatttacacgccttatcagccgaatgcagccgcattggatgcgggagtcggcgaaggcgacgcctgttcgacttacggcaatcgtaatttcgcaatcatctacaattcgatgttcggctctcctcgaggctgatttttcgatacaattgctcatggaagggactgaccagaaggagcctttcatgggcctactcaacaacaacgactatatcgacccattcaagggttccgattacatcgatcccagcagcaacgccgaacgcctgtctaatcaggtgaactgtgaccatgcacggcgtgaatcctatgtccagcggcgatatgtgaaacccgtgcagagcgatcaggcatcgcgcgacaggcaggccccacaaaacacccgatccaagcaagacggtagatctcaacaggcgcaaggcgatcagtccacacgaggagacacgctccaaaccatgttgaacgactggtccacgcaaaccatgcggtatgcccagtccatgcagcaaagcttgcaacaggcgttgcggcaaaatcagcaaaacccgcagaacccgcaaggacgcccatcgcagccctataatcctccgcgcatacaaacggaacgagccacacgcgagttccaatccacttccgacaagaagcaacgccgccataaaaacggcttcgtcaccgttttggagatcgttatcatcatcgctgtaatagcgtcgattggcggaatgctttctgacagcatgtcaaacatcatctccgatttcgatggatccacaagccagttcgaggagctgtccacacaggaaaccgtcagcgaagacgttggaaagctctactccaccggaggaaaagcattggaagtgaacatcgaaggcgtgcagacaggtccggaggatttgaacggcgacgccacgctcacggttttgctcacctgcacgaacatcggcaagaaaacgatgtatcctcatgccgtcgcagatctgatggtcatgcaaaacggcatcgagcttgcccctgcattcacttccaacgaggattccgaccgcacggagttctccggcgccgaaatgaaaccgaagaaaagctcgcagaccaccagcagtttcgttcttacggacaccaattcaccagttgtggttcagctgatgaattattcgcagcataatgttgttcgcgccgcgttttcctttgacgaagtcgacatagaaggatccttgaaacatattgattatgcggccgtccctcagcccgagcaagtggacgcttcgaatttcgacgaagacggatccgtaaccgattatgacgaaagcaccctgcatttccgcgtagactccattgagaagacaagcccctcatatgccgatcatgacatagcgttcgcacgcatatcctggtatgtcgaaaatggaagcaaataccgggctttcctgaactatatggatgtttccgcgacccaagacggcactgagttgcatagcacgtatcttgacgatgatagctattccacaacacgcaaggtcactcccggcgtgaaaatgacgacgacagtcgcttttgaaacgcaaagcaactcgcctgtgacattcatattttctgactatggtgatgagattcttcgcaaaaccgttaatttacggtcaattgagtcattggaactttaatccgatacttgcagaaacatcaaaagaagattcaaataatcattcggaaagcaaaagaccgttgttgcaatcagttttctcatgattgcaacaacggtctttgatgaaacgattgcggttcgcttacagcttcggcaggtacttcttcagttcgaaaggagtgacctgcttgcggtattcctcccattcctgacgcttgttgcgcaggaagtattcgaaggcatgctcgccgagcactccggccacgaagtcggacttctccataaccttcaacgcctcgtcaagagactccggcaatggctggatgcccatggcctgacgttccgcatcggtaagctcccacacgtcgtcgctggtcggctcgcccaactgcatctgcttgtcgatgccgtcaaggcctgctgccaagagcaccgaatatgcgaggtatgggttggcgaccgggtcgagcgcacggaattccatgcgggcggaattgcccttgcctggcttgtactgcggaatgcgcagcagcgcggaacggttgttgtggccccagcagatgtagctcggagcctcgttgccgccccacaggcgcttgtaggagttgacgtactggtcagtgaccgcgcagatttcagccgcatggtacagaatgccggccgcgaactggcgtgcggtgacggacatgttgaattcctggcccgcctcgtagaacgcgttggcgtcgccttcgaacaggctcaagtgggtatgcatgccggaacctggagcgtcggaaagcggcttcggcatgaagctggcgtgaatgccgcgctccagcgaaatctctttgacgacggtacggaaggtcatgatgttgtcggccgtggtgagcgcgtccgcataacgcagatcgatctcgttctggcctggacccgcctcatgatgcgagtattccaccgaaatgcccatctgttcgagcatgttgacggtggcgcggcggaagtccatgcctgggctgcgcggcacatggtcgaaatagccgccctcatcgattggggttggcgtctgggaccaatcatcctgtctttcgaacagatagaattcgatttccggatgcacgtagaaggtgaagcctttttccttggctttcgacagagcctgcttcagcacatgacgcggatcgcccaacgacggctcgccatcaggggtaagcacgtcgcagaacatgcgcgcggtgccttgcgggcctccacgccacggcagaatctggaatgtcgacgggtcgggcttgacgatcatatcgtcttcggacacacgggtgaggccttccaccgcggaaccgtcgaatccgagcccttcctcgaacgcagcttccaattcagccggtgcgatagccacggacttcagcgttcccaacacatccgtgaaccacaaacgaatgaagcgcacgtcgcgttcttcgactgtgcgcaaagcaaactcttgctgtttatccatagtgccccatcgttccatgcgcatgttacgaaagtcgttaacacgcgccgaatatgacgagaccgtccacgttgtggacggccgtatcgtcatgggtttgcgaacaatgctcaacgtgcgacttcaagcgcctcttccaaagtgaaggcgcgcgcatacagcgatttgccgagaatcgcggaatccacgcccagatcggcaagttccttgatggcgcgcaggtcatcgagcttggaaatgccaccggacgcggtgaccttcgcatcagtgcgttccgcaacctcacgcagcagatctatattcggaccgctcatcatgccgtcgcgagccacgtcggtgaccacgtaacgagagcagccaacggaatccaggaacgccatggtttcgaacagatcgccgccttccttcacccatccgcgggctgcgagggtgtggccgcgcacgtcaaggccaacggccacgcgatcgccgtacttcttgatgacggaagcggtccaatccggattctcaagcgctgccgtgccaatgttcacacgggcggcgcctgcttccaaagctgcgtcgagggatgcgtcgtcgcgcacgccaccggacatttcgatattgaccttgtcgccaagctccttgacgatggcgcgcagctggtcacggttgttgcccgtgccgaatgccgcgtcaaggtcgaccagatgaatccattccgcaccggactcgacccacgtgcgggcagcctccagcggcgaaccgtaatcggtttccgaaccggattcgccttggcgcaagcgaacggccttgccatcacgaacatcgactgcgggaagcaatgtcaaagacatgtctgtacctctctgtgatcaaccgaccgccactaaacggcaatcgcaaataaatgtaccaagtggtcgttttaaaagcgtatatgtcaaagcatcgtcgaaacaatcatcggcgatctcgcaccatcagaacgtcgcaatccaattgcgcagcagctgcgagcccgcttcggcggatttttcagggtggaactgcgtggcgaacagcggaccacgctcgtaggccgccacgaaacggctacgtccgtacgtgcaccaggtcacgcgctcctcggcgtcaccgaaatcaagctggtcgccggacgtgtcggcgggagcggcactcatcgcggcgaaggaatgtacgaaatagaaacgttcaccttccacacccttcatgagcacggaaccttccggcgcctcgacggtgtcccatcccatgtgaggcaccacatcggcgtcaagcagttccacgtcgcccttgatcaggccaaggcccggagtgccggtgccgtgttccataccgcgttcgaacatgatctgctcgcccacgcacacgccgagcaccggtcgcccggcacgcagacgatccttgatcacggtgtctccgcccaccgacttgagtccttccatgcatgcgccgaaagcgcccacgccgggcactaccagaccgttggcttccaaggcctgccgatggtcggaagtgagggtcacgtcaaggtcgagatcagccagtgcacgaaccatggaacgcacgttgccgaaaccataatcgaaaaccaccacggaagtcatgggcgttctccttcttgtgtcattcgttgttctgtgacgcgagtcgtcttgtgtcgcataacgcatgttcggcaggatgactcgcgtttaccgtcgttaactgatgcttgatgtgccgcgtccgaaccgcgtatgctcggcgataatgctcatcgccgcatcccgatcaaggtcagcggaatcgaaaatggtcatatccgcctgttccagcgcgttcatatcggtgatgcccagcatgagatcctcaacgaacggcgcggtggaggtgaatagcaccggcggagcgaaggttttgcccgctctgccttccacgtacatcgtcgcttcgagcttgtccgcacggttgacggcaagaatcgcgggcatgccggcaacgacgatcgtcatgtctttgaccgccgcttccggaccgtctccgtcgagattgcgcagcaccgcgacagcaccttgcgccgatccgatgcattgcgcggaaatgtcggacaattcacagaatgccgacagcaatcgtggcgaggtcagtctggtgatgatcaccgccactttcgcgcgattgccaagcagtccctgcagctcgtcttcgaatttcaacgaatcctcagccgcgttgagcatgtcgtcgacttccgaggattcggaggattcggaggattccgcgttatcggaagcttcggaggaatcgaaagcttcagatggcggattgtccgcccgctcatgcttggacgcttcggcatccttgaattcctgctcgaagccggccatggccgcttccagttcctcttcgctgaaatgcatgccgtcggcgttgaggtcaccgaaatcgtttgatccatcgaatccttggaaatcgtcgaaatcgttatttcgatcgtcgctcatcacagagcgcccttcgtgctcggaataccgtcgacacgcggatccgactcgatggcgaaacgaagcgcacgtgccaaggccttgaactcggcttcggcgatgtggtgcggatcacggccggagatcacctgcagatgcaggcagattccggcatgcatggcgatggattccataacgtgacgcacgagggagccggtgaaatggccgccgatcatgcagtattcgaagccttccggctcgccggtgcacacgcagtacggacgcccggaaatatcgaccacggccttggcaagcgcctcgtccaacggcacggtcgcatcagcgaagcgacggatgccgcgcttgttccccagcgcctgcttcaacgcctcaccgaacacgatggcgatgtcttcgacggtatggtgcgcgtcgatgtcggtgtcacccgtggccttgatggtcaggtcaatcagcgaatgcttgccgagcgccgtcatcatatggttgtagaacggcaccgacgtgtcgatgtcagttttgccggtgccgtcgagattcaggctcagttcgaccttggattcgctggtttcacgaacgatggttgcggtacgcgccatgttgcgactccttttggaaaatgttcggtcctgttgtgttggttcagtcccgtatgtgctcagtcttgttccacaatacgcaacacttcgaccaaggcttcacggaaacgcgccatttcctcgtcggttcccatgcatacgcgcatccagccgtcagggccgacggtgcggatgagcacaccacgcttgagcagttcgtcgaagatgcggtcgcgatcgtcgaaatgaccgccgaacagaatgaagttggactgcgtctcggccacttcgagcggctggcccttgtaggtttgttccttgagccatgccgcggtctgattgcgggtgtcacgcagatgcgccacacggctgagctgttcgtcggtatgttcgaacgcggcaagcgcggctgcctgggtgacggccgacaggtggtacggcatacgcacgatgcgcaaacagtcgataatgcccttgttggcggccagatagccgactcgcgcgcctgcgaaggcgaacgccttgctcatggttcggctcacggcgagattctcatactcgccgatgagttcgagcgcggtgggcgtgcccggatcacggaattcgatgtaggcttcgtccaccacgaccaccggatgcacgccttcggcggcaccggccacttcagcggtttcggcggcgccgagcacgcgcttgagatcgtccatcttcagcggtgtgccggtcggattgttcgggctggtgagcacgatcatggccggcttgacgtcttcgatggccttgatggtggcgtcgacgttcagcgagaaatcctcgttgcggtgcgccagcttccatgtggtgaacgtgtcgcgggcgtattccggatacatcgaatacgtcggatcgcagccgagcgcaatgcgtcctggaccgccgaaagcttggaacagctgcagcatgatctcgttggatccgttggcaccccacaactggtcgacttccagcttgacgccggactcgcgttcgagatagtcgcagaatgcctgacgcaacgcgatatgctcacgatccgggtaacggttgagcgtcagagcgatttccttgactcgctgcgcgatggtttcgaccactgccggttccggcgcatacggattctcgttgacgttgaggcataccggcacgtccaattgcggcgcaccgtacggctcctcaccgatcagatcgttgcgcagcggaagatatgccggaatggcgttgctggaagtctcactcatcgaaggcctgcctgctcttcctgttccttgatggtttccttgttgtacggatcgtcgatgaaacggctcagcacgctttcaccgtgtgccggcagatcttcggaaacggcgaaggcgttcacacgagcagcgagggtcttcaatccctgctcgtcgtattcgatgacttcgaccggcttcatgaaggtgtgcacgcccagaccggaggcgaagcgtgcagtgccggaagtcggcagcacgtggttggagccggacatgtagtcgcccagcggcaccggagagtacgggccacggaagatggcaccggcgttgcgaatcttggcgatcacggcatccgggtcggcggtctggacctcaaggtgttcggcggcatacgcattggccgcgtcaatggactgctcgatgccatcggtgaggatgatgccggactggcgtccgcgtagcgacgtgttcacacgctcggagtgctcggtgcgcggcacacggtacttgaggttctcctgcacctgttcggcaatctcttcgctgtcggtgatgagcacggaaccggcgagttcgtcatgctcggcctgaccgatcagatcggcggccagccagctcgggttggcacccttgtctgcgatgatggcgatttcggtcggtcctgccacggcgtcgatgccgacgatgccggacaccatgcgcttggcggtagcgacgaagatgttacccggaccggtgatcttgtcgaccggatcgcacaggatttcgccgtcctgcggttcggatcccttggcgccgtaagcgaacatggccacggcctgagcgccgccgaccgcatacacttcgtcaacgccgagaatggcgcaggtggcgagaatggtcttgtcaggcagaccgtcggcattgttacggctcggcggggttgcgatggcgagggattccacgccggcggcctgtgccgggaccacgttcatgatgacggagctcgggtagacggccttgccacccggcacatacaggccgacacgctgcaccggaatccaacgctcggaaacgcgcgcgccttcagccagatcggtgtggaacggcgccggcacctgggaagcggacacggcgcgggagcggcgcacggattcttcgatggcggcacgcacttccggatccaactcgtcgacggcggccttcatggcttccaccggcacgcgcaggttctccggacgaatatggtcgaatttctccgcgaagtcacgcagggccgcagcaccgcgggccttcacatcgtcaaggatgggctgcacgagatcggtggcctcgttggtgcccatctcggcgcgaggcatagcctccagcatttcagctcgggtcagcttcttgccacgcaggtcaatgattcgcatatagttttcttcgctcataacgccccatggtaacaacgtgatgtcacgagaacgcccgcgcgtctcaagttcagccgcatagtgagatattcggctgaactttcggcatcatccccacgaccggtcagcccaaaggcagagaactgggaccgaaaaggattttgatttcggcgaacagactcgtgtcgcggcgtacgcggaaacggtcgccgaacgtcagtaccttggcgttgcccttatcgtccatcaaggcgagcttcacttcgcagggtccaggatgatttgaaagaatctgccccaactgctgcacatgcgattggtcaagcgcaatcggcggcagcataatcgtcaccggcttctcatcctgcgcttccaacgtcggcacgttgaattccgtggcacgcatgcttaccgtctcatcgcgtttctcaacctgtccgcgaatctgcaccaccgtgtcgaccgccagttcgggagcggcggcctcatacactttgccgaagaacatgcactggatggagctttccaaatcctcgatggtcacaatcgcccaaggattgcccttcttcgacatacgacggtccacgttcgtgatcaaacccgccaccgtcacctgctggccgtcaggcatattcgccgcgcgatcgatcagatgcgcgatcgacatttcacgcaacgacaccagaatcgactgcataccgctcaacggatggtcggacacatacaagccaagcatttcacgttcgaaattcagcttggttttcttatcccactcctccacatcgggcacattcaccatggcatcgcccatgcccgcatcgtcttcgccggcatcttccaaatcggagaacaaatcaaactggccttcggcctgcttgcgtttcaaaccgaccaccgaattaatcgcagcctcatgaatcgtaaacaaggcacgacggttcggatcgatcgaatcaaacgcaccggccttaatcaacgattcaaccaatcgacgattcaacgcctccatcggcacacgcctgatgaaatcagggaaattcacatacttgccatgatcgttctcacgttccttgacaatcgcatcaaccgcagccttgccaacgttacggatggcgccaagaccgaaacgcaccacatcgccgacagcggaatactcgtacaccgactcgttcacgtcaggagacaacacctggatgcccatgcgacgagcctcgcccaaatacaacgcggtcttgtctttgttcgtactcgcaccctgcagcaacgcggccatgaattccaccggataatgcgttttcagatatgcagtccaatatgaaatcaaaccgtatgcggccgaatgcgccttgttgaacgcatagcccgaaaacggcacaagaatatcccacacggcctgcgccgcctcctgggaatacccatgctccttcatgcccgcgaagaacggcaccttctccttggccagcacctcgggcttcttcttgcccattgctcgacgcaacacgtctgccttgcccaacgaataacccgccagaatacgcgcggccgactgcacctgctcctgatacacgatcagaccatacgtttcgtcaagcacttccttcaacggctcggccacttcaggatgaatcggcgtgatcttctgcaaaccattcttacgcttcgcataattcgtatgcgaatccatatccatcggaccaggacgatacaacgcgatcaatgcggaaatatcgttgaagttattcggcttcaacgttttcagcaacgaacgcataccatcagaatccaactggaacacgccaagcgtgtcacctcgcgacaacagatcgtacgtggcacgatcgtccaatggaatcttcgtatggtcgatacgcgtcttgccattcgcctcgatattgttcaacgtatcgcgaataaccgtcaagttggaaagaccaaggaagtccatcttgactaaaccaagcgtttcacacgtatgatactccaacgtggtcgtaaccgtaccatcggtacgttccagcagcggcgacgtattcgaaatcggctcgctacccatgatcgtggcgcacgcatgcacaccggtctgacggatcaagccttcgatacccatcgcctcatccgtgacgcgcttcacatccggatcggaatcataaagctcacggaattcgcgggcctccgcataacgcttcgaactcggctcgaaaatatcatgcagcggaatatccttgccacccgtctgcgccggcggcaacgccttggtgatgcgctcgcccatggagaattcgtagcccatgattcgtgcggaatccttcagcgcctgtttggttttgatggtgccgtagatcacgcattgcgcgaccttgtctcgcccgtacttgtctccgacatagtcaagcacgcgaccgcggccgtccggatcgaaatcgacgtcgatatcaggcagcgacacacgttccgggttaaggaatcgttcgaagatcaagccgtgcttgattggatcgagttcggtgatgcccatggcatacgccaccatggcgcctgccgcggagccacggccaggcccgaccatcacaccatgcgatttggcccagttgatgtagtcggccaccacaaggaagtatccgcagaactgcatctgacagatcacaccgcattcgtaatcggcctgcttgagcacttcgatcggcggatgcccgtcataacgccgttccaagccttcctcgacttttttcaggaacagcgacgtctcatcccaaccttccgggcagtcgaattggggcatgaacgcgccatcttcatgatcgtcgaacatgacattgcagcgttcggcgatttccaacgtattgtcgcatgcttcgggaatgtctttgaacagctcacgcatttcttcggcggatttcagatagtagccggtgccgtcaaatttgaatcgtcccggctcgtcaagcgtggatcccgaattgatgcacagcatggcatcctgagagccggcgtcttcggcgcgcacgtaatgggaatcgttggtggcgagcagcggcgcgttcagttttttcgcaatgtccagcagaccgtcggtcacctgtttttcgattttcagaccgtggtccatgaattcgatatagaaattgtcacgtccgaaaatatcctgcaattcgcctgccgcacgtaatgcctcgtcgaattggccgagcagcagtcgcgtttggatgatgcccgacgggcatccggaagatgcgataatgcctttcgaatatttggcaaggatttccttatccattcgggggtatcgcatgacacgtccctcgagattcgcgtcagtggacgccttcatcagattgacaaggccctcatcggtttccgcccacatcgtaaggtgggtgatcaggccaccgccggatacgtcgttggggttgcgcctgcgatgttgcggatcgatatcgggattccagttggtatcccagctgacgcgggtttgatcttggcgtgcggtttccggcgtcacatacgcttcaatgccgataatcggtttgacgccttccttgaccgcagtgctccacatttcgtatgcgccatgcatgttgccgtgatcggtgatgccgacggccggcatgttgagttctttggcgcgcttgaccagatccggaatctttgacgccccgtcaagcagtgaataatgcgtgtgattatgcagttgcacgaaatttccggaagtagccatacgttccaatctaccggtgattggtgacgtgcgatcacacttcaggcttgtcttgtgtgtcgtgcctgccgcgcatcacgtcgagcgcatgctgcaaatcagctggataatgcgatttcaccgtggtccacacatgggttcgcggatggcggaattcaagttgcttggcgtgcagccactgccgttccaatcccaatgcctcacccagctgcggattggcaccgtacatggcgtctcccgcaagcggatgcccgatggacgagaaatgcacgcggatctgatgggttcgaccggtttccagattcacggaaaccagcgtcgcctcaccgaaacgttccatcacatcccaatgggtgatggcttctttgccggcgggcgtaacgcaaaaacgaaaatcggagactttggcacgtccgatcggcgcttcgatcgtggccttgttttccttgagattgccttgcacgagcgcatgataggttttgacgacttcatgttcggcgaactgcctgcgcatttccacgtaggcgaggtcagatttgcacacgagcatcaatccggatgtgcccacgtcgaggcgggatacgataccctgacgtcccgcggcgccgtaggaggtgatgtgcactcccctgtcaagcagactgccgagcaccgtcggaccggtccaaccgacggaagcgtgagcagccacacccactggcttgtcgaccactatgacgtcatcgtcttcgtagaccactgccatatctcgtgcgatcggttcaggctcggtccgttcctcgacaatatcgaattcgacggtttcgcctgattgcagagtcgatgatttggaaatgtcacgaccaagcacgcgcgcctgtccactttcgatgagttccgcggccttggctcgggagataccaagcatcttggccacggccacatcgaatcgtttgccgacaagcgcgtcgggtgcgggaacaagacggctcatgcgttctggtctccggtcgtctgtttcgtctgttctgcggcctgttcgtcaagatccttctggctgaagggctctccgacaaacagcagtacgacggcggcgacgcccgccaccatcaggaaaatatccgcaacattgccgaccgaccatccgtaattgaggaaatcgacgaccttgccattaaggaaaccttcggcatacatcacacgatcgatgagattgcccaatgctcctgcgaaagcaagagcgaacaccaccgtccatttcatggaaatggtacggattgccagtacggccaacgccacgcatgccacgatggcaagcaacgaaatcaaccaggtcatgttggatcccatgcccaaggacgcacccggattatgcaccagcgtgaatgagaggatgcccggaatcacacgtaccgtctgcccgtcggcaagcgccgactgcgcccatgccttgctgatctggtcgagtaccagtgccacaacggcgatacacgcaaagacggccacgcgggtgcgcagccgtctttgatcatttgtcatgatgtcagacacagcctaatctcagtcgtcctgggagtcctgatcatagttgttcgtgtcggacacctgggacacgagctggccgaggaattcggtaagacgtgcacggtattcggtttcgaactgcttgaggccctgaatgttgccttcgatgaccttggtctgcgcttcgagattgtcgcggacctgctgggcgtagtcgtcggctgcggtacgggtcttcgaatcgtagtcgaaggcgcgcttctgcacttcggactcgtattcgtcggcttcgttgtgcttcgtggagaagtaggtatcaccatcctgggtcttctgcacgaggtaggcgtcgccttcctgagtcttctgatccaagtaagcatcaccctcctgcgtcttctgagcaaggtaggcgttaccttcctgagtcttctgatccaagtaagcattaccttcctgagtgcgctgcgccagatagtcatcgccttcctgagcacgcttggtcagataggcatcgccttcctgagtcttctggttcaagtagccatcagccttggcacgagtgtcagccgaatactgatcggcttcggaacgggtgccttcggagtagttgtcggcttcggtgcgagtgcggttggagtaatcgttggcattgccgatgagctcatcgtacctacgctgggactcgtcggtgatttccttagccttggctttgcccttgtcgacgtactggtcgtgcagctgcatagccagggtcagcatggcggtggcacgctccggctccgtgttggcgctggctgcggctcctgcaatcttctgcaggcttccggtttcggtactcggttcgaccttggcgacctgctcgcgcagctgggcttcacgctgctgcgattcctgcagctgctgtgcaagctgctgaatctgcgcggcctgctgctgggcacgctcatcctgctgctgggactgtgccgcatgctgctgcgtgagctgctgagcttgggcgacctgctcctgagcctcttcaagccttgcattgagctgctggatctcagccgcctgctgctgggccaccacaacctgctgctgtgcggaagccagctgacgggacaggtcttcggtctgtgcacggaatgcgtcgcgctcatgctgcatggaggtcagctgttcgcccagatccgcctggcctgcagcttcagccgcctgtgcggtgagctggtcgacctgtgcggacaggcgatccacctgacccttgagctgttcgttctgagccgacagagcacggttgctttcctcagcctcggtgagcttggctgctgcgacctgtgcggcctgagctgcctgatcaccagcgccagctgcctgctcggaggcggacttcaatgtcgcgttctcctgctgcagggactgaacctgggcgctgagctcggaaatcttggagttgagccccgcaacatccgggccgagggactgagtagcctggccgctggcaaccgcctgcttgccaagggcctccaccgtctcggttacctgatcgagaaaatcgtcgacttcatcgacgtcatacccctccttgaacctcacggtctggaaggtatgctctctgatatctttcggcgtcaacagagccataaatcttacacctcgctttgggcttgatgccttgctgttgttgctttcattgttcgactctagcacgggaccaccgattttttgcgaaaaatcggcatttgacatacattaaatgaggaaatcaatagcaatgagaatgaaataaagaacgatgaatgccacatcgaagtagatgggacccattggaatagggcggatatattggcgtagccagcgcagtgggggctccgtcaactggtaaaccgcgtcgatcaacgacgacaccaacccccgtggacgccatgccgatgccaacacagcaacccaatcgagaatcatgcgaatgaacagcaccagaatgtaggcattcaccaaaaagtggacgatgctaccgatcaaagacaaaatcatggggcaccaccttagcaacagaacataacaaagcccccatcacgggtgacggaggcttcatgcagtctgctttcgcaacggctttcgtctatatcagtcggcgaacaaatcgtgcgacgagttattcgcctgcggttcctcaaccttgatgttcacctgagctgggctcagcaggaacacgcgcggagtgacacgttcgatggagccacgcacgccaaaaaccacacccgcggaaaagtccacaatgcgatacgccacggcctcggccacaccggtcaggttcagcaccaccggaacgccgtcgcgaatggcacgtccgaccagctgagcgtcctcataggatttcgggtgaatcgtggtgatacggctcacccttccgccttggaacgggttggctttggtctgctcgcgcggtgcggacgtcgcggcaggagtcgaagccatcggggtcacggaatggtcggaatcgaacgaggtttcgctgctctcagcctcttcgttgaaatcctcgtcaccttcggcaacgtcggtcatgcccaaataggacatcgcgcttttcataaaacctgccatgaacgatcctttcgcgtcttcgcgttgcttttagcgcaggaaatccggaatatccaaatcgccggcgtcgttcgaagacaccacttcatgctcggtggtctggtcgaatgacggaacgacgggttccggagtggacggaatataagtggacagcggctgcaccttcggggcttccggagtctgaataagctgaggctggggctgctgcggaaccgccgctgccctcggggctgcggacaacgccgacagcggcaccgtgctttccgcaggctctgcctgcttctgggcttcagcctgagccgccttcttggagttggcatcaaagcctgcggcgataacggtgacacgcacttcgtcgccgtaagcgtcgtcgagggaaagaccccagatgatctgtgcttccggatggatggccttgcccaccagctgggtggcggcggccgcttcctgcaacttcagatcggacgggccggcgatattgatcagcgcgccgtgggcaccctcgatgctttcttccagcagcggcgagctgatggcgatttcagctgcctgggtggcgcgatcctcgcctcgtgcggaaccgatgccgaacagtgcggtgcccgcgccacgcagaatagcgttgacatcgttgaagtcgacgtgaatgtacgagttcgaagaaatcaggtcggtgatgccctgcacgccggccagcaaggcggtgtcggcggtcttgaacgcatcgacgatgccgatggtgcgatcggaaagctcaagcagtcgatcgttcggaatcacgatcagcgcatcgacttccttgcgcagattctcaatgccaagtgctgcggaagccgcacgctggggaccttcaaagctgaacgggcgggtaaccaccgcaatggtcagggcaccctgctgatgcgcggcgcgagccacgatcgggcttgcaccggtaccggtgccaccaccctcaccgcaggtcacgaacaccatatcggcgcccttgagcgattcctcgatatcggactgatgatcctgagcggccttggcacccttctccgggtcggcacctgcgccaagcccgcggctggtggcatcgttcaaggagatcttgacatcggcgtcggaacgcatcaggtccttcgcgtcagtattgatcgcaatgaattcaacactttgaagaccctcggcaatcatgcgattgacggcattaccgccagctccaccaacaccgacaaccttgatattcgttttgtcgttgaaattgtcagtctgggcaatctcgctcaccatagtctcctgtcactcgcgtttacgcacaactttatcgcagacacgctgcagtacgcgcacttttcgccgtgtgtaacggcgttttttcacttttttattgctaacgtgttcatttcgcctgcgatttaccctctttcggtgcccccacgacgatttaaccacatcagcatgtcatattcaatagctggcgtccataggatcatccccaaacaacgcctgacgttcatcatgcgatgtttcccgtgattccaaccatccgtaaggcagatgcactttctttgcgaagcgcacgcgcccccttggcttgtcgaccactcgctcgggaaaacagatgttgggatccagcttgcctatttcggctctgacatcctcaagattttcacattccatgaacgcgcgacgggtggagcctccaacggggaatcccttgagataccacgcaatatgcttacgcagatcatgcacggccatctgctcatcgccatcatagaattcggtcaacagttccgcatggcgttcaaccacacggcacacatctcctaacgtggggtcaacacgcttgtcgctgccagcgaacgcattcttgatatcggcgaacagccatggcctgccttggcagccgcggccaatcgcaacgccggcgcaaccggtttcggcaaccatggcaagcgcatcgttcgcaccccaaatatcgccgttgccgaacactggaatgtcaagcgcttcgaccagctcgccaatccggctccagtcggaatgcccgccgtaatattcggcggtggtacgcgcgtgcaaggtcaccgccttgcagccttcctcctgcgcgatatggcccgcttccaagaacgtttcatgctcatggtcgatgccgacgcggattttagccgtcaccggcacgttggcagcatcgcagaccttgaccacacgctggatgatctcgcgaaacagatccgtcttccacggcaaagccgatccgccgccgcgtcgggtcactttcggcacggggcatccgaagttcagatcgacatggtcggccatgttttcgtcgatgacgattttcgcggcctgttccacgatcgccgggttcacaccgtacagttgcagcgaacggattttctcgctcggcgcgaaatggcacaaccgcaacgctttgggattgcgtgcgaccaacgcgcgcgcggtgatcatttcggccacgtatagaccgtccggtccgtagctttcgcaaatcacgcggaacggccagttggtaacgcccgccataggcgaaagcaccaccggggtttcaacgtgtaccggccctaaatcaacaggcttcataaccggaggaaccgacggcctcaccgcgtcggtacgcgggtcgagcacgtcggattcctcgtaagcagtcacaatgctatctggcataagaacgctatggtaaccagtatccagctttaatacaagccaccggcttcggcgatcttgacggactcaggccaagcctcgccgcccatctcaaccggcacctgcgggtaacgtacatgcttctcgccaatacgtgcggccacataatcagccaccttgtcgagtgcgacgcgctcctgctgcatggtatcacgttcgcgaatggtgacggcctgatcgtcaagcgtgtcgaagtcgacggtgatgcacagcggggtgccgatttcgtcttcacggcgatagcgacgaccgatcgcaccggcctcgtcatagtcgatcatccagtcatgctgacgcaaatcggcggccagatcgtgtgccacggtctgcaattccggcttcttgctcaacggcagtacagcggccttgaccggagccaggcgcgaatcaaggcgaagcacggtgcgcttgtcgacgccgcccttggtattcggggcctcgtcaacgtcgtaggcgtcaacaaggaaggccatgagggaacgggtcaggccggcggccggttcgatgacgtacggcacgtatttttcgccggtggcctggttgaagtagctcagatcctcgccggaatgcttggcatgcgcggaaagatcgaagtcggtacggttggcgacgccttcaagctcgccccaatcggaaccctggaagccgaacttgtattcgatgtcgacggtacgcttcgaatagtgggccagcttctccttcggatgctcataatggcgcaggttctccggcttcacaccaaggtcgatgtaccactgggtacgcgcgtcgatccagtactggtgccattcctcatcggtgcccggagccacgaagaattccatttccatctgctcgaactcgcgggtgcggaagatgaagttgcccggagtgatctcgttacggaaggacttgcccatgttggcgatgccgaacggcggcttggaacgcgaagaagtcatcacgttcttgaagtccacgaaaatgccctgtgcggtttccggacgcaggtagtgcagcgagttctcgtcttcgaccggtccgaggtgggtgcgcagcatcatgttgaagtcgcgcggttcggtccagttgccacgggtgccgcaatccgggcacacaatgtctttcaggccgttttccggcagcttgtcgccatgcttttcggcataggattcctcaagcttgtcggcgcggtggcgcttgtggcagttgaggcattcgatcagcggatcgttgaacacggacacgtgaccggaagccacccacacggccggcggaagaataatggacgtgtcaacgcccaccacgtcgccacgggtgacgaccatggaacgccaccattcgcgcttgatattgtctttcagcgcaacgccgagcggaccgtaatcccacgcggaacgggttccaccatagatttcaccggcgggaaaaacaaagccacgacgcttggcgagggatacgacttcatcgagtttggatacagccacaatgcaccttctggtttgaacggtttggggtctttacaagcgcaaagcctacctttacgcggtgacagaacgccacccgcgttactgtttcgtggcgttctcgtcttcaaccgtgtcgttgtcgagcaatagcgaccagatcttgcaatcgatcaccacggcatttttcgtttcgtcaccgtttctgtcaagtgtgtaggtcacattttccggcacggcgatacggttgatgttctgcacggatgccacgaaattacgcatggcatcatagcttcccgtggcggtgatacttaccgacacctgcaccagctgaccggcttgaatggtaccttgcatttcagctggaatgtcggcgtcgaccgcatcatcgaaattcaccgatttgatggcgacgccggttcccgcagcggacgcatccaacgaattgatgaattcctgctggttatagccgtctggaatctgccgctgcaactggcgcaaacggtctttctgcaggccgatcgtttcgctggcgatgcgtaatgtttcgatttcgtcgcgtgtttccttattattctcatcgatttgcgcagtttgcgcgtcggatgatttgatatggctgatttgcggggaaacgccgaccagccatgtcagcatgatgacgaagacaatacctgcggccaatgcgatccatgcgattttatgcttgttcatgattgctcccgatcattcattggatgtttcgtcagttgcggtcgcgctgtcggtagtatcagtcgactcccctgccgcggctttgttcaggctgtcgcgtagctgctgctgcaatgctcggttggcttcgtcagcaccggccgcgttgtcgcttcgtgacgtggtattggtatccatcttcaacgacaccgttcccgtgtatgtataggtggtgccgttttcatcgctgttttcggtaatggaactcacatagcctgttttataggtaggaattgcagcaaaattaccgataaaatcttttgcagatatgaaatctggagaaagaacggtaaaatcaacggaaatcacaccattcccagaccatactgaagatgtagcgctatgcgaagaagcgtcagacccgccaatctggaagctgctcaacgacaggttcgtgtactggcctccggctggcagcgcgccattgagcgaatccaccaccttcatccaatccatttcgtcgtagagcgcggcgatacgtgacctttgcgaatcggacagcgagttcaacgtgtcttccacgtctttgaattccgccttttccttctgcaacgacagggttttcgcctgtgcctcctccacgcgatggtcggcccagctcacgcgcaccgccatgcccgcgctgatggcaatggccgcaaccgccaccacgataagcacgtatgacagcaagtatttgatggcacgatcacggttgagtgtcacgatggaacgtggcagcaggttggcgcgcacattccattcggcgggcagatcagcctttttggaggttttcgaactgctcgcacgcagcgctttgccgatgtcggaaatattcatcgacaaaatcgaggttttctcgccatcactggtttcaggattcggattatccttgattttgccgcgtcgaccgcggtgggagctgccgatctgcttcatgcttccgttgttttttctgctcatcgtccgttcacctcggcttctttccgattaccagtccaagcactgcgcccaaatcgatcgcgtgcgccatgatgttctgccgttccacttctttggaaagccggaaacggatgaaggggtcgccgatccgcaccactttgttgatggaactggccaataccggcggcagtccgatcagccgtgcgccggttccggtaagcaccacgccgctgatggtgccgcccgcatggtccacgtcgtacaggttgagcgtattgcggatgccgacgatcagctgcgccgtggtttcgcggatgacttcctcggctttttcgagtcgttcgtcgccggtcacgttttgcaggccgatctggtttttgatgcgttcggcgtcttcgaatgagatactgagcgcgttggcgatggcgtcagtcacgtcatccgcgccggatggcacgacgcgcatgtaggcgggctgcccgttttcgagcacgatcacgtcggtgccgttgccgctgatgttgaccaccgcttcggtctgctgctggttggtgtcggcgaacagtctggcaagcgcgaacgggcccgcatcgatcgatgtgatcacaaatcccgcgtcttcggctgtgcgcgcggttttttccagtccgttacgcaatgtcgccacgagtatgccgtgcaactgtttgccttgttcgctgtcgatgacgttcaatggcacgaagtcgagctcggattcctcaataggcagcggaatcatgcctttggcttggaaaggcaaggtggatttcagatcgttcagcgacatgtagggaaagtccgcctcgcgaaacaccatgcgtcggctggagtagacgagagccgtgtcctcgcgggggaatttgaatcgcttcaccagtgtgttcagcagtccggccaccacatcatggtcgaccacttcgccatccactacggctccgttcggcaacgggatcgcctggaaatgcttgatggtgggcagatccgaatacgggtctgctatgaccgccgcacggatggcgtcgttcgcgatcgacagcgccgttattgatctcatgctctctccttatatataacgtgttgcaggttggctggggattggttcaggcgagtcccgtcacttgcaagtacagtgtggcgatcggagccccgacgaatatgccaagccatatgccgagcagcatggacggtccgaacggtatgcctccatgcatatcgacttttttgccgataatcagcacaagacttaagaatcctccaataaagaaggctgcgaacgccccgatgatgaattgcgaccatccgagccagcccgtaatcaagccaagtatgaacgcaagtttgatatcgccatcgcccatgccacctttccatatgatggaaagcaataggtagaacgcgccgagcactatcgcacatatcacagcgcgaccgagcctgttccactcattcgtaccgagtgatgccaaagccagcagtgccagtgttgcaatcagcgttggcaatagcacaacattgaggatcagatgatggtcgaaatcaatgtatgcgatcacgatcgaaaccgctgcgaatacgtagagttccggcaatatccatggcgaatacgcgccgaatagcgcccccaaggtgacggcgaggaacgacagtccgcccaacgcttccacaatcgggtagcgtacggcgatcggttctttgcaatgccggcatttcgcgccgagcaccagccaagaaatgatgggaatattgtcataccatgcgatcggggcttcgcagttcgggcagaaactgcgtttcggatttaccaagctgatgtggttgggcacgcgccaaatcaccacgttcagaaacgatccgaaaatgcagccgattaccagcgatgccacgagtagcagcaccacagttggcgtatcgttcacaatgctcatgttcacatccatctcgcgcagcgctcaccatgcgatagtggacgggttcagttctttggatgtcacgtagcctttggtggaggatggctccaatgtggtagaactaccaccgccataaatcacgccgccgcctgagccgcctgttccgaggttaaccgaggcattccacacctgcgatttgatttctcggttcaaaaagtctcgtgccgatccgcatttggccataatcacgtcggcatgcccgtcgatacgtccggagtatgagggattgccgtcgattttgtctcccggatacacttccgtcaggcattgaccgttgagttggaacgtacctttactgtgctcgtcagacgctttttcgttgtatcgggtgaatgttggcgcagccgagcattccataagttggaatttgcccgaaccgccgaacccatagcaacgcttcgacccgttcaccatcgtccaaatctgcgtgttcacgccactgccgtcactcgacgtgtcttcaacatattcggcctgatcggttttacgcttggtggaatcggacaccccgcagtagtcgatctgatgcagatcggaagatgattgcgccggattgccattgatggtgttgtggtagcagtatgggttgaaatcaccgccacccactcggcaggttgacgtgtatgcgtcgaatccgtcttgcgatgacgaaatgcagaatccggacgtttcattgacgatctgcttcgtggcatagccggcttctcccgcctgtccgaacgatgcggtggcgtcttcgaaatcaccgttcacgtcgaaccaggatttcacgtcggtgagcgaataatcccacttcgacaccatcaggaaatgcggagtcaaatcgacagcatcatcgacgttggacgcccagtgaccgccgctcagatattgaatagtggcgcccacattcgccttgttggaaacttccagcacttggaagcgggtcttcttctgcatttgcacaccgccaacggcatagccttgcgattccggcagagacgcatcatacttgttcgcctcatcgcgcacgctatctagctcgttgtagtagcccgcattgatgaaaccgttatagaacgcccacttctggtatttgttgagcaggcttgacggatcgttcttttcgtcttgctgcgctttcttgtcaggatcggtgtaatagtcgctttggtagttggggccgtacgactcgccgcatttctgcaatgtggcggctcctgcagtgcctccgccaacatgcgtaatgtcagctccggtaacgcacaatgtcagattggatgcagggcgaatggaatcatccttccaatacacccatgtgttcaggtctttgtaggcgccgttggctttgcactgttccgtgtaatacaggtcgtcgctgctggagtctttcttatgcgcttgcataagaatcaccaacgccgatccttccaccggcttgccgttcgggtcaagcatggcgtcaagcgtttcgaccttgtctacaggcttggtggtggcaagcatgcaagtttggtttgccggattcatagtgatggtattgctcatagcgtcggccgcattcttggagccaggcttgttgacatagttcaccatgccggtcggatcaccgttctcatcgacatcatatgaggcgatttccttccaggtcggctggttggtacggcgctcgttgtttggcgctgccgcgtagaagcccataccgagacgtccacccttggtggaaatcacgtagctgtcatcaccgctcgctgtctcgaattggtagatggcgctcatggctcggcgcgcgctggtttccgtacccgcgcttcgcccattcggatacctgttgatatacccgtaggaacgcacccacgcatatttcgcgttcttcagctcgctttcggatgtgagtcgtttggccggcgatgagcttggatcgtcgtcataatatccgatttgcactcggtacgagatatcgtctggagtgaacgagctcacgcccgttgccgacacgtcgttgctgacttccgcattgttgagcagcaccgacccgtccgatgctgtagtgaaggtctcatccaagctggcattgccagtgtttgatgcggtcgacggtagcagtttcttatagtccttgcttgcttccgcttcgcgcaggaaactcaatgccacttcgagtccagattcggcggcatacccgacttgcgcgttctccttattattcctgtacggcaatgcttgcgaaagcagtatggtcattaccagtgccgacgtggtgagcaccaccattacgaacagtaccgcgagcatcatggccgcgccccgctcccccatgcgttggcataatctggcacgatacctgcggttgagtccggcccacaatccgttcttcatgttcaaccttcccgctttcgcttacgcttgcccgttgatggcgtcgaacatggagaacatcggcatgtacaatgccaccaccatgaagccaaccacgctaccgagcaccagaatcatcaacggttccagcaacgaagtgagctgtttggcgatggattgcgcttcttcgtcatacgctttgcccgcgctggcgagcatctggtcgatggcgccggaatcctcaccgatcgccgccatctgcaccatcatgttcgggaacactttttcggtacccatactgtccgccagcctatagccgcgttccacgagtcgagacactcgtttggatgcttcgtcgattacataattgccggatgtggatccgacaatgtcaagcgcctgcagaatgggcacgcccgaagcgagcatggatgcgaaattgttgcagaatcgcgccaatgccacattggtggtcagtttgccgaacacgggcgccttcaacgtgaacggatcccaccaggtacgaatgatgtctttgttgcgattgcgcttccaaaacatgacgaacgccaccgcgcacacaatgatcacgggaatgccaaccggtgcggccttgcccatatcaaccatgatctgcgtgacccatggcagttccgcgcccatcgacgcatacatgctgtcgaacatgggcacgatggtcagcagcatcacgcccaccagcagcacagcaatgccgagcaccaccaccgggtaagccagtgcgcctttgatctgaccttgcaaacgcacgtccgcttcaaagctgtcggccacggtaatcagggatttgtcaaggaagccgccggtttcgccggcccgcaccatgttgatcataatgggcggaaacagatggtcgggattattgtccattgcttcggaaaacgatgatcccgcctcaacctgctgcatgcagtcacgtaccgcattgcgcagtttcacatttccgatttgttcagtaacgatattcagtgcgcgaatcagggagacgcctgccgccaccatggtggcaagctgacgtgacataaccgcgaagtcttttttgcttggatatttttcgaacgctttgatttcaatattagtattgagaccggtgcctgcgttcacgtcaacaagttccgttggaatcagaccgagcttattcacgcgatcgatggcctgatctcgcgtctgcgcttcgataacgcccttctgcttggtgcggccgtcagcggaaacacccttgtaacgccacttcttggtgccgttttgaaatgccacttgcgcctgttccctggccattactcccccatggaatgattgacgaacaatagaacgaatatggatatggaacaaggtatcggagcgatacctcatacgctccgatacctttagactctgacttctgaattcacttagccttaattcttcgcaggcttaatttcagagacggtgccattggttgaatcgtagacaaatgttgaagttgtttttccatttgagttcgttccggtaatgatgtatccatcaccatttgcagtcgtggcgaaatggagcttcacaccttccgtgacggtaaccttattaccatcaatgtcgcaggcactagtgtgagtgcaatccgtgcccggcagagtaggaatcttgccattgttggcagtggacgcagtttcaaccacaaggctggcgttcttgacgtcggactcggtctgagagttccaggccgacttgcgctggttcaggtagatcggcacggagatggcggcgaggatgccgatgatgatgaccaccacgagcagctcgacgagggtgaagcccttttcgcccttggcgcggcggttgagtgcgttgcgcacgctcttcataattgaatccttctttccttcgggaaaggtcgccgctcgcatcccacgatggagcttcgcggcgttcttctatcgatcgtccccttgtgggggctgctggctcacataaccaacagtcctaactttatccgcattgacatcgtttgcagaaccattattccggcgtcaatcgttttacgagcgtttcattttcgattcattttcccctcatccttcatccgcacaaaagcgctttagtttaccccacaacccccttcacaaccatcaagcaaatcacactttttcaagcggacacaaaaggtacaacacaaaaccaaaatcgtgcaacaaaaaatacaacaccacaaatagcttgtttttcagtacaatcgctcagcaaatctttgcagtcacgtttttttgaaaaaactggaataaccacccttttcgggcgtgtcgcagggtgctgacgggggcaacaaaaaacggctggctccataaggaaccagccgtctgccgcaagatctagcggaacactcagccacacggagtgaaatcgattgcagttccacccgatttcacattgcgtgcggtgaacgacgtggacgtattcgacgtgaccggcttgccgctcacatacgaccccgtcaccggcgaataacgcaccacccgattggtgccatccaccgtgaataatcgcgaggcgaacagcgaatcatcagacgtgcctcccgactcgttgttcattaccgaccccaacaccgcgcgcgtgctccatgacgtgacggacgcatcatacggcttcgtttttaccttcacgctgccgtaatcgcttaccgtaccgttcttccacgtggcgtcctggtacgtgatcaccacgcactgcttcgcaccagaatcccccggagtgaccatggtgagcgtatggttcgtggcgtcatactcaacaccctccgcgtagcgcacataccggtcgaggctttgcaccgacgtggctatttccgtggaagacctgcttcgtatcgcatccgcgctggtggaatgcaggtattgcacgatcgccgtggtgaacatggtggagacgatggcgaagatgaacagcgacaccatcatctccaccaaggtgacgccgctttcaccgcgcgccatacgttgcgcgacggcgcgaatacgcagttttccgcttgttgttccgctcattgcaacccctcactagatgatgagcttgttgtcgacgccaatatccagcagttccgacgtggtgtacaggcaggttttgccctgatgcatgttgtcgtcccatgtgacgcctaccaccacgcggatcatgggcatatacgtgtgcgcaccgaacgtgaacgcgcccgataccgttttgcccggatccagaatgtcggccgtggcgcttgttgaggtattggccgtatagcttgttgcggaactacgggaaatgcccagctgagatgcggtcttgcacgagatctcgccgctggcacggaaacagcgctctaccaccgtgttcaccgtgtattcggtatgcttggcgtccttgcccgcagtggcacgaaccggctgaatatacttgctcttgtctggatcaggcgaactggtatagctcagatccgccaattgcgacgcgatggcgccaacgtcggaaagattcttctgcgcgtcggtgacggacgtttcccccatgcctttgatgagttcatcgagatattggttggcgtctacattggcgatctgcgcacgcattctttccatgccgtcgtcgcccagcgacacggcggtggaccgctgctgctgcgcatatgacgtgcgaatggccgtaatggcgaactgtgcggcggcaagtcccgtaatgctcaacaccacgatcgccaccagcacttccaccaacgtgaagccggactcgccacgttttggcaatcgattgacgcgactcgccgcaacccctgaatcgggggcgtctcccgctgtgcgcaagctgtactccatgagcagctccttcacaagatgccaccccatcattggaagcggcaggaattcggcacgcaaccaaacgcggtgccataaacatgagttactgtatcacgatattctgccaacgttttcacagcaacatatttctcaaaaaactttgccccgattagcttttacctgtttttgcggctacaatgctgatttagcagtacacaatactgcaatcgttgtagctcacatgacttcgaacaactgaacatcagccgccccacaaatgctgccgtttgcttggggtttcatgttatgccgtatgacaggcgcataagcgcgcatgcggtgcaggaggtcattatgagcgacgccggttcgggaggccgtttccccttcctcaggcgaaacaaaaacagcgacacgacgaacgctttcccgcaaagtatggatccgatcgcgccgacaaccggcgagatccatcaggtgttcgcgccgagcacaccacgccatgcggcaacgacaagcgacgtcaccggagattttcccgccatgccaacgtccaccgagggcatggacgaacagaccgaacgccaatatgccatggcgttggcgcaaggcatgagcctgccgttcgtggacctcaacgaataccagatcgacaaagaagtcatcagcatggttcccgacgatctgtgccgacgcaaccagcttctgccgctttccatcgtcaacgggcgcatcgccgtagccatggcgaatccgaaaaacttcgccgcggtagacgatgtttccgcaacaaccggcatgcccgtcatcgccatggtcgccatgccatcgcaggtacgcgactgcatcaaccggttcctgcgcgccaatgcggagttgaccgaactatcgcacgagatcgccgcgaccgcgaaaaaagaagtcgaccttgaacaagacgacagcgaagacgcctcccccgtggcacgcttcgtaagtctgctcatcaaccaggccatcgacgaccactgctccgatatccatatcgaaccgcaggaagacggtctgctcgtacgctaccgcatcgacggcgtgctgcatatcttccaaaaagcgccacgcgccatgacccaaggtgtgatcagccgcattaaggtcatggccgaaatggatatcggcgagcgccgcaagccgcaggatggccgtattaccgtacgtcacaacggtcagaaggttgatcttcgcgtggcggcattgcctacggtgtggggcgagaaaatcgtcatgcgtattttgagcacgccttcgggcaatctcaaagtggaggatctgaatttcagcgaacgcaatttcgatgtgttttccaaagcgtacaaccgcccgtacggcatggtgttggtgactggtccgaccggttcgggtaagtcgaccacgttgtatgcgacgttgggcgatgtggcccgcccggaaatcaacatcatcacggttgaagaccctgtggaattccgcatggagggcatcaatcaggtgcaggtgaacaataaggcgggtatgacctttgccgccgcgttgcgttcgattcttcgtgccgatcctgatgtggtgctgatcggtgagattcgagacgaggagacggcgaccattgcgatcgaggcttcgctgacgggccatttggtgctgtccacgttgcacaccaatgatgctccgagtgcggtgacgcgtttgacggaaatgggcgtggaaccgtttttggtgagctcgtcgctggctgcggtgatggcgcagcgtctggcgaggcgcctgtgcaagaaatgccggaaagccgatacggccactcccgtggagttgaagatgatgggtgtgccatatacgcccggctctccgttgccgaccgtgtaccgtgcgatgggttgccgtgaatgttccaacaccggatatcacgggcgtgtggccattcagcaggtaatgggcgtggacacgcagatggaggatttgatcgcgcgtggcgccacgtcgctggaaatcgagcaggcggccaagtcgaaaggcatgacgtcgcttcgtgaggatggctggcagaaggttctgcaaggcattacttccgtggatgaagtgcttcgcgtgaccgtgtagttgtgtaatcgtgtgaccgcgttttcaacatatgtaaaggacaatgatgaccgatattgaacagcaacccgagctgaaaaccgaaatgaacaccgcgacggatcccgatgcgcagccgacttgggatgcgaacaccgatttgtctggtttgaaaggtgtgaccattcccagtaccgctccttcattcaacgaggatccgcgtaggggacgccattggtcgcccgacaatgcgattcaggctgacgatgacagtttgcgcaatattttcgcgtcgcttgacgccatacccgcgttgcggcatggttccggtaccgttcccgaccccatgcctaaggccgcggtcgagcaacagccggcggccgagcctcaacagagcgcacagcggcagcctatgcaacagtcagctgccccgcaagccgttgcatcacaatctgtagcggaaccgcagcccgctccgacacggcctgcggaaacaccgctcattgcagaacaacaggaactctcctacgacaccgcttttccggaaaccccggaaaacgaagccgtggatcagcagaatctgcaattcgacgatgacgtgacggaagtcacccctgcattcgagtatcatggaccgatccagcaaatcgacggcgatccgccatcattcattccaggcggcacgccgttcgcgcaacagccggacgactatgcggcgtacgaggagaacacgcagaccatgcagccttccgccatcaaccatattgcgcagcctgcgcccgctgccagaccgcaacccaatatgaacaacaggctaatcgtggatttcatagtgcccgaaaccaatgattccgacgaggacgctgttcccggacaacgcagaatcaaagcgcaccaggtcaaagaaacattgcatgccgaacatcccgatgcggatccggaattcgtggctgccatatgccagctggtggaattgaacgcgtccgatcttcatctggtggtcaacgatccgccaatgctgcgcgtggatggcaagctgcgccccgccaaagggctgagcgtgtggaacaaggaccgcacgtatgaagccatcaaagtgatgaccaacgagctggagatggaacggttcaaagacgatttggaacttgatatttcattctccatcggcgatctgctgcgattccgcgtcaacgtataccgcgaccgtttgggcgtgtgcgcggcattacgaaccattcccacggaaatcaaaaccgcgcaggagcttggtctcgacccgcatatcgccgatctggcgttactgccgcgtggactcgtgctcgtatgcggtccgaccggctccggcaaatccaccacgctcgccgcgattgtcgacagagcgaatgccgaacgcgccgaccatatcatcaccattgaagacccgatcgaattcgtgcatcaacacaagcgttgcgtgatgagccagcgtgaagtgggcaccgacaccaaaagtttcgcggaagcgcttaaacgcgcgcttcgtgaagatcccgacattatcgaagtgggcgagcttcgagacctcgaaaccatttccaccgcgttgaccgccgtggaaaccggccacttggtgttcgccaccctgcacacgcaggacgccggttcgaccgtggaccgtctgatcgacgtgtacccggaaaatcagcagcagcagattcgcgtgcaggtggcctccactctgcgcgcggtggtcgtgcaaaccctgatttcacgtgccagcgggcatggccgcgctcctgccaccgaagtgatgatcaacactccggccgtggccgcgttgattcgcggaggcaaggcgcatcagattcgtaccgtgctgcaatccggcgaaaaggaaggcatgcatacgcttgaccaagatctggcgagactcgtcaacaagggcgtcatcaccttcgaagacgctcttgccaaggtgcaggtcctcgaggaattcgaaaaactctgcggcgcccgctcctccttctgacctcgccgtacccatacaccatctttacacctatcatgagcaacacagcagaaacaccaaccatcatccagcccgacgtttcggcgaaccgcgcgacgaaccttcgaaaaagactcttcacctggttcgccgaacaacggctgcactgcattgtcttcatcgcctacgtgacagtgaccgtcaccgtgtcgtgttttcacgaaccatggtttgatgaggcgcaagcctggctgatcgcacgtgattgctcatggaaggaactgcttaccgtacgcacccattacgaaggacacccacctctttggtggatgctgcttgccattcccgccaaacttggcatgccttacgaaataggattgaaatccctcaatcttatgtgcgccgcgctgatgatctggcttttggaattcaaaacgaaactacccgaattactaaaggtaatactgccattttcctattttctttgctaccagtatggcgtaacttccagaccatatgcgcttatgatcgccgcaatgctgctcatagccatcaattggaacaaccgcaacaccaagccatggccagtcatactcagcatgatgctgctatgcgccacgagctcttacggattggcaatcgccggcatgcttgccttgaattggacgattcaatttctctgcggcgaacgctcgcttataaaaaacaagcagcgtttcgcgggacttgttctgctactggtattcgccatcatactgctcctcaacgtactccccgcacccggcacataccacggtgactttgacatacatggcactgcaacaacatcacccgcatgggtttccgtattcaacacctggctggtaatgccttccgagacgttgttcacttcaaccctgtcggatggcaatatgcagttcatcgctctcacgccaagcgagctgtttatgccgtgcgtaatgtcatgcctgatgtggtgttttcttattcagatttgcctacgccggaaaaccgcatcattgctgctcaccacatacttgggtataagcgttgcgttcaccgcgcatctttccatgcatcatgcgggaatcatcttgggattcttcatcgccattctcgccatcgattgcgatatcgaaaaaatcaattccaacgattggcctcagtggatccgtaatctcaacaaccgtgttatgactcttcttggaccgaagaaaacggaacggtatctccgtttcttcaaaatcctcggtcttatcttcatgcttgtcagcgtgtattggacggcaagcgccagtatttgcgatattcggtacgactattcgtcttcccgggcggtagcgtcttttatcaaaaccaaccatttggagcaataccgttggatggcaggctggacacgcgtcagcaagaacgacaccgcttccaatccagaaatcaacaaaatcatcgacaaaggcggatattgcggcggcaccgactgcatcgactacacttcttggtacggcagcacccttatcgattcagccccttacttcgaccatacgcttcttgccaatgcatacaagggacgaagctattcgtcgtgggaatggtgcgttgacccctatgcgggaaagaaagacatcgaaacatggaaatcgtggggcgaacccgaattctacgacactctgtatcagccatttttcttctccgaccttggttacgacagaaaccattacacgaaaatcaaaatcgccgaaaccaagacaccttggaaaagcacatggtcggaaggcgcctgcgaaatttacgtgcgcaacgacatttacgagaacgtattgcattcgcccgatcctggaatcgactggcccgacggcgcaacgcgcagataacaagtggaccggcatccaactggaacgtgtcgattgttcgtttatgcaaaacgtgccactgtcagcacctttgtataggttagatatgttatgtacatgcaggggggcttccggcgaaagcggaagctgagataggcaaatgcctgaccctttgaacctgttggttaggaccaacgtagggagcagacaatgggcgatgactcatatgcagctgcattgcgtgaacagattgcgcaggcagtaaacgacgtacgcgaaaccacacctttggcacagtcgttcaccaatttcgtaacgatgaatcttgtggccaacgcgcagctggccgccggcggcaccgcagccatgagcttcctgcctgacgacgtgatcgacaccgcggaaatcgccggatcgaactacatcaatgtgggcacactcctgccgttcttcaaggacgcgctaccggaaatcgcctacaaactgcacaagaacggcaagacgtgggtacttgatccggtcgccgcgggcatcggcaaaacccgtaccgccattctcgaatcgttccgcacatacccgccgaccattgtgcgcggcaatgcgagcgaaatcatcgcgctcgatgcgatgtggggtttggcacagcatgattccaccgttcccggcactcgcccggcaggcgtggaagccgtcgacgaagtcgattccgccgttgacgcggccaaacgagtggctcgtcatcttgcgaaatactcccctgttggagccggcgcggtggccgtttccggagcagtcgatctggtgactgacggcgagcgcgtgttccgtttgcccggcggcagcgcgatgatgacgaagatcaccggcgccggctgttcgctcggcggcgttaccgcaacgtatctggccgtggccgaaccgcttgtcgccgcgatttcggcatcattgctgtataacagggcttccgaaatcgccgaagcgaaatcgtccggtcccggatctttccaagtggcgctgcttgacgcgctttggaacgtcaccgccgaggaagtcgccgcttccgaaatcatcatcgactaggctttgccgaaccctgcatggtattcggcatatcatgcagggttcggcaattgcgtatgtggaaaatatggacgattgccggttcacattgtaggttttctgaatcacttaccgagaagggttgattatatgaacaattattcatatgcatcgatgcgcgatacattcgatatgagcgcctactttgtggtcggcccgcaggattgcaagagccgtactattaccggtgtgattgaggatgcgttgcgcgggggtgcaacgttcatccagctgcgagccaagaacaccgacgcgaaagacatcaccagcatggcacgcgatatcgcgcaggttatcgagaacaacggcaaatccgattccgtggcgtttgtgatcgacgatcgcgtggatgtagtttggcaggcacgtcacaagggcatcaaagttgacggcgtgcatattgggcaaaccgacttggaaccgcaggaagcccgcgcgttgcttggggaagatgccattgtgggcttgtctgccgaaacggaaagcctggtgaagctgatcaacgagctgcctgccggctgcatcgactacatcggggccggcccgttgcacgtgtccaccaccaagccggaagcttccgttggtggcaacgatggttccgggcatacgctcgacgaggcgcagatcaatgcgatctgcgatgcgagtgattttccggttgtggtcggcggtggagtgaccgccgacgatatggagatgctcgcacattcgaaggcggccggctggtttgtggtgtcagccattgccggcgcaagcgatccggaagaggcgacccgcaatatggtttcgcgatggaaggcagtgcgcggtgatgcaaagcatgggcacgtactgcgcaaatagcaatcacggatcacgaatatttcagaacttcgcatcataagcaagcaaaagcaagtaaggagtcattcatgaccagcactttggcaccggtattgagcatcgcgggatcggattcctccggtggtgccggcattcaggcggatttgaaaaccatgcttgccaatggcgtgttcggtatgaccgccatcgcggcgctgaccgcgcagaacaccacaggcgtgaccatggtcacgaacactcctccggaaatgctcgccgcgcaaatcgacgcagtatttgaagatattccgccggtcgcggtgaagatcggcatggtgtcgagcgtggagctcatcaacgtgatcgccgaccgtctgattgcgcatgatgccacgaatattgtgcttgatccggtgatggtggcaacatccggtgcgaagcttatcgaaggcgacgcgattgcggcactgacttccaagctgttcccgctggccaccgtcatcacgccgaatatgccggagacccaggcgctgtgcgagctggccgtcgaacagggtgccgacgcgatcgactacgagaatggcgaaagcatctccagtgagaacgacatggtgacggcaggccatatgctcgccggccatttcggctgcgcggtgctcgtcaaaggcggtcatggcacgcaggatgccagcgatgtgctcgttgaaccgagcggcaaagtcacttggttccgcgcgcgtcgtatcaataatccgaacacgcatggcaccggatgcacgctgtcttcggcgatcgcatcgcatctggcgcttggcgagacattgccggaagccgtcgatagtgcaaaactgtatctgacgggcgccttggaggcgcagcttgacctcggtcacggatccggaccgatggatcacgcttggaaatggcgctgacagccaaatccgcaccagccaatccaagtcgtatcaggccgataggaacgcaacgaaaggaacgaacatgacccttgatcgcaatgcggaaaagcaggaagtgccgatcaacccggaaaccggcaaaccgtatatcaacacgcttgccgcagtcgccatctcccccgccggcgcaagccctgaaaagtccacgtacgtggcgcaggcggtcgacgtgatccgtcaatccggattgccgagtgaaaccaacgccatgttcaccaacatcgaaggcgacatcgacgacgtgctcaaggtgattcgcgacgccaccatgaagctggctggccagggctatcgcaccgacgtggtaatccgtctcgacattcgcccaggtttcgaaggtcagatccacgccaagcaggcacttgtggacgaaatcctgtcggaataaatcaggcaataaactgttagatcgtcagaaaaatcgaaaagcgcgctatttataaggaatggcgcgcttttcttattgatttgggtatagtgtagcgaatatgactacgatgaaggaaattgccgaagcggcaggggtatccatttccactgtttccctggtgcttaacggcagggatgaaggacgtgtgaaagcccctttggccgcgctcgtacgcgagaaggcagacgaactcggctacacggtcaatcctctggcgcgcagcctgcgcacttgctgcacgcgaattctcggcttcatcagcgaggaagttgccaccacgccgtacgcaggcggcatcattctgggcgcgcaagacgcggcaagcacctacgggtacatgatcatcacggtcagcaccgatggcagggcgagcgaagagaacgaaatcgccacgctgaaacggtatggcgtggacggtttcttctattcgaagatgtcgaatcgcattgcgagcgtgccagcctcgctcggcgattatccggtggtgatggtggatgccaccgatgccgacaaccagattcccagcatcgagccggacgaattccaaatcgcctatgatgccacgaaacggctgattcaggccgattgcaagcgtatcgcctacatcggatgctcggaaaacatgattgcgcaggatggccgttttgccgggtatcaggcggcattgcaggattccggtttcgcctatgatccttcgctggtatgcaatgtgctcaataatggtcctgcgttgcgtgccgtcgacaaactgtttgacgaacgcaatcccgacggtttcttttgcttcaatgatgcgcgcgcatggtatgtgtacgaatgtgcggcacgccgcggactgaccgtcggcaaggacgtttccatcgtcggcgtcgacaaccaccgcgtgttcgccgaaacgctggaaccgcagctgaccacggtggaactgccccactatgagatgggttattgggccgcatgcaagcttatttcgatgatcgaacgcaagcccgtcgacagttcgtcttggccgaataccaccgctcccatgccgccgttggattcgccgattcctgcgaagatccattgcgcgctgatagaaaagggatcggttcgcagctaagtttcgcgatctaagaccacatgaaaggcctgttgacgtgtccgttacgacacgccgagaggccttcttttttatcccccatttcggcttaattccaacacttccaaaaagcgttggaattacttacgtcaatcgattgacgtcaatcgtttgacgcgctattatttaaccatgttcatccacttggcacggcagctgggtgaatgacggcataacacaacatcggcacacaaccgaggtgccgcgcggcagcggcacaaacaaagagaaacagagaaacaacaacatggcaagtacaactcgatctgcatggaagaatccttcctacctgcagagctccttcggcatcttcatgttcttctgctcgtggggcatctggtggtccttcttctcccgctggcttaccgacccggcccacggtctgggcatgacctccgccgagcagggccagatctactcgatcaactccctggcaaccctggtcatcatgttcgcctacggcgccatccaggaccaactgggcatcaagcgtaagctcgtgatcttcgtctccgccatcgcagcgctcgtcggcccgttcgtgcagttcgtgtatgccccgatgctgacagccggcggcaccacccgtttcatcggcgtgctcatcggctccatcgtgctgtccgcaggtttcatggccggctgctccctgttcgaggcactcaccgaacgctactcccgcaagttcggcttcgaatacggccagtcccgagcttggggctcattcggctacgccatcgtggcgctgtgtgcaggcttcctgttcaatatcaacccgctgctgaacttctgggtcggctccatctgcggcctcggcatgctgtgcatctacgctttctgggttccggccgagcagaaggaagagctcaagaaggaagctgatccgaacgcggctccgaccaacccgtccttcaaggaaatgatttccgttctgaagatgccgaccctgtgggtgctcatcgttttcatgctgttcaccaacaccttctataccgtgttcgatcagcagatgttcccgaactactacgcttccctcttctccaccactgaaatcggcaacgccacctacggcaccctgaactccttccaggtgttcctcgagtccgccatgatgggtgttgttccgatcatcatgaagaagatcggcgtgcgcaactccctgctgctcggtgcaaccgtgatgttcctgcgcatcggcctgtgcggcgtgttccacgatccggtcagcgtctccatcgtcaagctgttccactccatcgaggttccgctgttctgcctgccggcattccgctacttcaccctgcacttcgacaccaagctgtcggcaaccctgtacatggtgggcttccagatcgcttcccagatcggccaggtgatcttctccaccccgatgggcgccctgcatgacgccatgggcgatcgcccgaccttcttcaccatctccggcatcgtgctggcagccctgatctacggcttcttcgtgatcaagaaggacgaccaggaagtcggcggtgatccgttctacaccgacaagcagctcaaggcccaggccgctgcagaagcgaacgcctgaacgcaatcgcaagtccggccaagaacataactgaatcgtgctgctcgaagcgtttcccctttttccgcttcgggcagcattcttacaacttttactcaaaactcaataagcagcaattcaacaatcacaagaaaggctattcaacgatgactggcttcaccccggacgcacccgtccttcacgaaatcaagaaccacagcgaggctctggcacaggcggaggcgggcgttgcagccatggccgccgcgcgcaacaaccgttggtatccgaagttccacatcgcctccaacggcggctggatcaacgatccgaacggcctgtgcttctacaagggccgttggcacgtgttctaccagctgcacccgtacggcacccagtggggcccgatgcactggggtcacgtctcctccaacgacatgctcaactggaagcgtgagccgatcatgttcgccccgactctcgaagaggaaaaagacggcgtgttctccggttccgcagtgatcggcgatgacggcgagctcaagttctactacaccggccaccgctgggccaacggcatcgacaacaccggcggcgactggcaggtgcagatgatcgccgaaccagacaacgacgagctgaccagcgccaccaagcgcggcatgatcatcgattgcccgctcgataaggtcgaccaccactaccgtgatccgaaggtgtggaagaccggagacaagtggtacatgaccttcggtgtctcctccgcagaaaagcgcggccagatgtggctgttctcctccgatgacatggttcgttggacctacgagcgtgtgctgttcgaacacccggatccgaacgtcttcatgcttgaatgcccggacttcttcccgatcaaggacgccgagggcaatgagaagtgggtcatcggcttctccgccatgggcgcaaaggcctccggtttcatgaaccgcaacgtttccaacgccggctacatgatcggcacgtggaccccgggcgaggcgttccagccggaaaccgagttccgcctgtgggattgcggccacaactattacgctccgcagtccttcaacgatggcgagcgccagatcgtatacggctggatgagcccgttcgttgagccgattccgatgcaggatgacggctggtgcggcaacctgacccttccgcgtgagatcaccctgggcgccgacggcgatctgcacaccgctccggttgtcgaaatggagggcttgcgcgaaaacaccaccgatttcggtgcgatctcgctggacgtcaatggcgagcagaccattgctgacgatgccgaagccgtggaaatcgaaatgaccatcgatctcaacgcctccactgcggaacgtgctggtctgaagattcatgcgaccgaagatggcgcttacacgtacgtggcgttcgacgatcagatcggtcgtgtggtgatcgaccgtcaggccgcagcccagggtgatcgtggctaccgtaccgccccgctttccgccgaggaactggcttccggcgagctcaagctgcgcgtgttcgtggatcgcggctgcgtggaagtgtacgtaaacgacggccgtcaggccatgagctccttcagctacgcttccgaaggcccacgagccatcaaacttgttgccgaatccggcacgcttgaggtcaagtccttgaagctccacaccatgaagtccatcggactggagtgaggctaatccaaggcagtagcaaggggtaaagagtaaggcgggtttcgtgtcgaatgagatacggaacccgcctttcgttttggtttggaacgtggtttagggagtgctttatactggcaccccggtaatgaacttttctgaccggaacgcgggcaggctcctcaccttactgatttctcgccaccggtcacgtgcgcgcccactatggcgcagaaagcaaggtgaacgatggcggtttcgcacgttcaacgcagggattcggcaacaggatccataccctcaaacacgagttcgcacatgggttcgggcatggctgcgaacacgaattcaaaagccggcattgtcgcaaaacttctcgaagctttgtccgcctttgctcacgtttgcaaacgccgtattcccacggttattgcagtagtgctgttgctggcggtatgggaggcgtgggtccgcatcggcaatgtgcccagcaccatgatcgccgcgccaagcgaaatcgcacaggccaccgtcgaaacatggtcgacgttatggcctgccacgcaagtcactttgcttgaaggtaccgtcggattcctgttcgccgtactgttcggcattctcatcggcatactgctgtactgctcatgcattgcgaacgccgcattgctcccgttgctttcagctgcgcagaccatgccgttgatttccatcgctcccctatttttgatctggtttggctttgagatttccggaaaaatcgtgattgtaacggtattcggcttattcccgattgcagtgcagacgattcgtgggcttgaagcggtcccccagttttattcggatgttgcgctgacttgtggcgccacgaaagcgtggacactgtggcatgtgaagctgcgtgtggccgctcgtcagatttatggcggcatccgcgtttccgccgcatacattttcgccaccgccgccaccgcagaatatttgggcgcgcgcaaaggtcttggcatttggctacaggccgcctacaactcgttccgcacaccgctgatcttctcggcgacgctggtcatcatcgccatcaccggcgttctgatgtgcctggtgaacctcagcgaacgcgtactgctcggcccagctgatgccgacgccgatcccgatgcagaccagtaagtcaaacacgccaaacatcatcggccttctgcaaacgcagcattcgcagcattcgccactccgcattgcatgtcggtcacgctgcctacgtataataaaacccgctgttaagccaatgcgtggcaaaccggcaatattccacgcctttcattaggcaccgtaaggaatgtcgggggcattggacgagcgggggcctgaggcccttcgtatcgttttctgcccgaactccgctcgcagcatatccctagaaaacgatagagaatacagattcaagggaaatcgctttatgagcatcttcagcaggcatgacgccaccgcacgtactcacatcgcaagcacaataatcgcactcttcagcgcaatcgccatgttgttcagcgttaccgcatgcggacaaagcaacgattccgtaacaagcacagcatctggcagcagcgatctgaccaaagtgaccttcatgctgtcctgggcgcccgacaccaatcatatcggcgtatatgtggcgaaaaacaagggttatttcaaagaggcaggtcttgacgttgatatcgtggccgtggcacaggccggtgccgaacaggccgtgaacaacggcgtggccgacttcgcattgtcgaacctcaccaacgtaagcacgtacgctgttaagggcgcaaccatcaagcaggtgctgcaggtacagcagaagccaagcgccatctggtgttcgctcgcttccaatactgaaatcaaatccccgaaggatttcgacggcaagactttcgccacgttcggatccaacgaatccgatgcggtgatccgtcgcatgattcagtcggacggaggtaagggcgaattcgacaaggtgaccgtcggcacgtccacgttccaaacgctgtccagcaacaaggctgatttcggtggtttctatgccacttgggagggtgtgcaggccgacatgtacggtccgaagctcaactgctttaccgaaccggattacggcgttcccggcaatgccgacaccattggcgtgatcaccagcgacaagacgatttccaacaatcccgaactggtgaagaagttcgtacaagccaccaagaagggctacgagtacgcatattcgaatcctgacgatgcagcgaagatccttgtgaaggaagctcccgacgcgaatctcaggcttgatttcgtcaagaaaagcatgaaaaccattgtggacggtcagtattggggcgatcccgccaagatcaaggatggttcgttcacgttcggtacgaacgacgttgaaggcgcccagcagtattttgacttcctcgctcaggaagacgcctacaccgattcgcatgacaaggtggtgcacgacgctccgcaagccaaggatctcgccaccgacgaattcctgaaataatcgggtttgaacgagtaggtttgtaacccgtttaggtgcgaataatcgaaaatattggaatacggcatcctgcatttttatttcatgcccaacactgcttgctcagttcgggttgaacatggtttgtgggatgccgcaccattatgtgttgcatttggcttcattgcacgagtttgattaaatacaaatatgacacgactgattcttgatgtggacaccggtatcgacgatgcactggcgttggcataccttgcgacgttcgacactgttgacgtgcttgacgtgcttgacgtgcttggcgtgatcggcacgtacggcaatgtttccgtcgacactgcggttcgcaatacttcgtatgtgctggaacggttggggcttcggcacattccggtgatacgtggatcgtcgcatccttcatgggctcggtgtttcattccggatgcaggttgtgcgcagtttcacggcacggacggattgggaggattcggcccggcttgcgatagttcgtcttcggatactgctttttcagatattttttcggataattccggttctgatactgttttttctcgtgattatcgtagtctgatttccgttggcggatatgcgttggatgatgttcatgcgaatcctgcggttgattcgtttgaattgtcgcttactacggattcggcttcttttattcatgctgatgattcttccgccgacttggtttccgaaggcgtgcagttcattattgatcaggttcgcgcttatggtttcgacgtcactgtggttgcgaccggtccgctgaccgatattgatgctgcgatcgcggccgcaccggatattgccggcaaactcaaactggtgatgatgggcggcacgttgacgcaggaaggcaactgttgggatctgactgcggaaacgaacatcattcaggatccggaagccgcagatcgcgtgttccattccggtgccgacatcaccatggtcggcttggacgtaacgcatcaatgcctgatgggttccgatgcgacccgtgcttggcgcgaagcggcgaatgctgacacacttaccagctcgaccgcatcccaagtcgctgattcacttgatggttcagctggtagttcaaatgcagcttcagctcgaacctcgagtgtggctgcaagcccatctgcttccgatgtgcgcgtattcctcgccgacatggctgatttttccattgccgcaaatctcaaggccgacgcgcgactgttttcacagggcatgccattgcatgatcctctggccgccgccgttgctgtggatccgtcgctggtgacctgtatcgacctaccaatgaaagtcgagctcgaaaccggcgatttccacggcacccgaggccgaaccatcggcgatcccgccggactgatcgactccaacgcaccccgcatccacgtagccttccaagtcgactcctcccgtttcgtccccaccttcaccacccgaatcagcacgttgtaacaaacaaaacggggagaacattatgttctccccgcagttaacctaatcaactcagcaaaaactactttttgacgccgccgaaacgacggtcgcggtgaatgtagtggtcgatcgaacgccatagcacgtctcgaccgcaatcggggaacagttccggcacgaaatcaagttcggcatatgccgcttcccacggcaggaagttcgacgtgcgctgttcgccggaagtacgaatcaccaaatcgcaatcaggaatatcaggattgtacaggtgctcggaaatcattttttccgttacgcgatcgccggagatcttgccgtcacgcacttcctttgcgattgccgcgcaagcatccgcgatttcggcacgtccgccgtaattcaggcagaacaccacgtcgatggtcgtgttgtttttggtacgttcctgtgctttttccaattcgtcgataacggatttccatagtttcggacgtcggccggaccagcgcacgcgcacgccccacgcgttcatctgctccacacgacggtggatgatatcacgcgagaagcccatcaggaaacgcacttcctgcggggaacgcttccagttctccgtggagaacgtatacagcgacaggtagcgcacaccggcttcgatggcacctgcgatggtgtcgaacaccaccggttcggcagcctgatgcccgtcggtgcgaatcagcccacgctgctgcgcccaacgaccattaccgtccatgatcacgccgatatggcgcggaaccttgttcttcggaaaatcaggaataatcgacgggtcagaaaatggtgccgccggaatgtcaagggacttgtaatccacgttctcaaaagccatacccgctaatctagcaagcgcatggaacgaatcggacgttccaaatagtattcaccccatttttctaccatttgtcgggtttccggaagcaacgccgtgccgtccagctctccccaatcgccgtctacaagcgcctgcaactggcagatcgcattccacgaaacgtcaaacgattcacgaatatgatcggtcaaacacatcaggccacccgcggaaatcgaaaagaaccatggacgatcagcagaaatcggctccccgcacaccacgcaggcacgcaaacgcggcgtccaaccagcgatcgcaagagcacgcatcacgtaggaatcgccaatcgcagcagcctcatgcgcatgcttggaaagggcattcaacgctcccagcaccagccgatactgtgccacggaacgctcctgctccgtcactaccagcttgtcagcggtttcgcaaatcacattcgctgcggtatacgccttgaaatcggtgcagatgcctctcgcatacgccgacaccgactcggcttgggaaatcacatcaagcgaacgcccttccgcaataagcaacgagacgcgcatgaaaggctccaaacgacctccgaaacgcgatttggttcgacgcacacctttggcgacggcgcggattttgccatggtcacgtgtcagcaaagtgacgatacgatcagcttcgccaagtttgacggtacgcaagaccacaccctcgtcctgatacaacggcattcacacacctccttcgcctcgactcgttttcttaactgaactatctatactttccgcacgttctcgcgccagccgcactctcccgcgatatcagtaaataaacaatccccagaacgcgaacaccagcagcacatacagcatggtgaccgccgtgatccaaaacatcacacggccgaacctcgtcgacgcgagcaccggctggcggccactcacaatcgcgcctatagcccctttacgcggtggccattgtgcaagaccacgattcgtcgcctcctcgataagacgcacgaacacgcgagaccacgcccacaccacaacaacacacaccatttgaataaccggccaactccaatacatcatgcccggatcctcggcgggagcgccaccccacgctagcttgaccacgcccataaccacttcgctcaatcctgcaccaaacagcacaaaagtggccatggtggcaacggcaagcgtaatcaacgcatttttgaacacaggtctcagccccaacacatatcggcgtcgatgcgcatgcgcccaaatcttacgtacgagcacaatcagccacagcacgccgatcaccagtagcaacagcaccatgctggtatgcagcaccacgagataaatggtcagcccgctgttcgcctgcaattccaacggcaccgcaatcgactgatacaagttggtaccggccacacgctcgctggtctgctgcagtccccgcgtgatgccgacagcccaactgattacatcatccacgtaggcgtcggcgaacggagtgccgctgttggattcgtcgccgagtcggagcacatggttggcgatggggtatgtgcgcacggtcacgtcccaattgcccgccttatgcgccatgtcgatgattttctccgtaccttccacctgcgcggtcatcacgtctttggtgccgtatgccacaagcgtgggaatggaataggcttggggattcaacgtgtcgaggtcgagattggtcaggccgaacaattccgcatcgatgttgaacgcgcggcgcacaatggactggtatccatcatgcgctccgaccagcgcgaaatcctgtgcggcaaggaatcccaacgaatgtcgtggcgaatacaccattgggctcagcaacacctggaatgccacgtcggggtcttgatcaagcagatatgaggaaatccaagtgctttcggaagtcgcgtaaatgccgacattcgaagcgtcaacgttgtcgagatcacgcaacatggtgatgacctgatcgtaaatggccgcggagcccgggtaatcacgggtcgcatcgttggtggaccataccggcttgtcgagcacggccgtcacgaagcctgcggatgagagatcggtggccatgtctccaaatgagttgtcacaggtaccatatccggcaccatgcatgaacaccacgccgggccgattgtttcccgcgtctttcggctctcgaatcaacactttgacctgttgtatttcaccggttgacggctgtttcgcctcaatggtgacatatcgttgcgtcacttcgtaatcgcctcgtttggcaagggttttgccggaaggattatcgaaggtcactgccgtgtcggatgataacgtttcgatggtttgaccggttggctcgtacttccatgacgatgccgtcaaattggataccgacaccagaatgcccagcaggatgatgaagataggcagactgaccatcagccgtctgcccctcgtccactgactggattggctctccgcgctggacatgactgactgacgttcctgatctgacacgccgttcattgtaccgactccagctgaaatggcaatcgacaaccagcaaaaccagcgggcggccgatcacaatctgcaatcgaccgcccgcggtcagcgaaatcaacaattgccttgcgccaccggcaccaccaccggtcctgtggcgttgacgggcacctgtccgtccgcttccatctgcgcggcgatctcctgcgctttgaccagcagcgtttccacaatctggtcttccggcacggtttgaatgactttgcccttgatgaaaatctgtcccttgccgttgccggatgccacacccaaatcggcttcacgggcctcgcccggaccgttgacgatgcagcccataacagccacgcgaatcggcgcggtcacatcctttaaaccttcggtcaccgcattggccaactgaatcacatcaacttgggaacgaccgcagctcgggcaggagataatgtcgaacttgcgcggacgcaatcccatgtattccagcagcttgcacccgactttcacttcttcgacgggcggtgccgacagcgaaacgcgaatcgtgtctccaatgccttcagccagcagcgcaccgaatgccaaacagcttttgatggtgccctgccatgccggtccagcttcggtgacaccaagatgcaacggccaatcacccttggaagcgagcagacgatacgtttccaccatggtgatcacatcatgatgcttgacggaaatcttgaaatcatggaagccgacgtcttcgaacatgcgcgcttccttcatggcggacgcaaccagtgcctccggcgtcggaccgccatatttcgcatacagttccttatcgagcgagcccgcgttcacgccgatgcgcaacgaaatgcccgcgtccgtggcggctttgcaaatggaagggccaacctcgtcgaatttgcggatgttgccggggttcacacgcaccgcagcgcagcccgcgtcaatggcctggaacacgtatttgctttggaaatgaatatcggcgatgaccggaatcggtgatttccttacgatttccggcaatgcgtcggcatcatcctggcttggtacggccacgcgcacgatatcgcagccggctgcggtcagttccgcgatctgctgcaatgtcgcgggaacattggctgtcagcgtattggtcatggattgcaccgagattggcgctcccccgccgactggaacgggaccgaccataatacggtgcgatttgcggcgcggatgcagcgggctttcgctaatggctgcctcaccggttttacggaacggcttttcgatttctggcatacgtcaaatccttgcaataacaaggctcccgacttagggagccttgcgtcacttacgtttcgtctgtttgttttgtttcgttttccgttacttgtttatcaggtcgtcggctcgacgacgggcttccagctcgagttggctcatttcctccacggaagcgaatagcggattgccgcgcagttccgcatccatttcgtccaacacttccttgacggtatcgacgatgccgagatatggcaagcgatgttcgaggaaggcgtgaacggcctgttcgttggcagcattcagcacggccgtatgcttttcggaagcttccaagcaatgtcgagccaagctcactgcggggaatgcctcatcgtcaagcggttcgaacgtccacatggcggctttcgtccaatcacaggccgctgcgatgttgccaagtcgttcgggagccgataggccaagcgcgatcggcagacgcatatcaggcggtgaagcctgtgcgatggtggcgccatcgcggaattccaccatggaatgcacgatggattgcgggtgcacggtcacgtcgatacggctcggaggcacgtcgaacagacggctcgcttcgatgacttcaagccccttgttcatcaacgtggacgagttgatggtcaccaccggacccatattccaagtagggtggttcaacgcctgttcaggcgtgatgtcggtcatctgctcgcgtttccaaccgcggaacggacctccggaagcggtgaccacgagtttcgacacttcaccgtgcgtgcccgaacgcaacgattgccagatggcggaatgttcggaatcaaccggattgatctgctgcgcacgaacctgtgcgtcgaacagcagatgaccgccggccacaacggattccttgttggcgagcgccagctgcgatcctgcctgcagtgccgcaatcgaaggttcaaggccgatggatccggtaatgccgttcaacaccacgtcggcaccggatccggccatggcgattaccgcttccgacccggccatgatttccacatggcttgcgccggcttggtttagcgcatcttggagcgcatggaccgcgtttgtattgaagatggcgactttcgaaacgtgaaattggaccgcctgttgggccagaagttccacgtgggagccgcctgccgcaagtccgaccacgttgaaacggtcgagatggcgggagatgacgtcaagtccttgggtgccgatggatccggtggatcccagaatgactacggttgaggtttgcatgggttatgcgtgtgctccgtatttgttttggattattcgtgtgaacgcgaaaacaggctgacggtcacgtcagcctgttcagtgcgattgcctattcaaaagaggggaacgacaggtcgggaatatcgacatccagattgctgttggatgcttcgaacatcggattggttgccggcttggtttcgttcctcttctcttcctctgccggtttcgccggttcaacgggagttgccgttgtcgagtgatctgcggaggttgctggttccagcgcgaaggagggtgggacggtcggcaaggttccgagattaatcgagtcggtattgacctgcggaaggttcggcgtcgacaggcttggcatgcgcggggtgaacgtgtcttcgaccggatcgggagcgtcgatgttctgggccatctgcgccaaggcagccaacgaagaatcgggagcgatgttgatgccgtgagattcttccggctgatgtgcgaccgaagtgtctggaatcacaggagccgcaggcgcggccggagcgtcatagctcggcgcgccatcatcagaaagcggattgaacgcttcggtttccgttcctgcggaagatggctcctcgtcaaccgcattggacgctttgaacaggtgtgccaacgactgttccggagccgctggagcaaccggagcggcctgaggttccggcgttacaggagctgccggagttaccggagccgacggggtgctgatggttggctggaacacaggcggaaccacgggagcatacgtcggcgcagcggtctgagtggccggaatgctcaccggggacgttgcaggcgtggtgaaaatctcacgttccgccttattcaaagcgtcgaaggagtcagtgctgttttgaacctgagcgggctgcgcaataggttctgcggaaacggctggaacggcgaataacggcgagaccacctgcgtctcttgggatgccagactggttgcgggcggattggctgcggccatcgcgctttcggagggctcgcccacgaagtcggccacacgagcataggattcgagtctggtcagcagctgcacgcattcgttcaggtaataatccacctgacgctcgtcatagccacgcttgcccttgcgctgggtgaagatcacattcgccacggtctgggagttcagatcgacaagtttcttggcatcgtcttccgacacttcctcaacgccgagctcgccagcggccttcgtcaggcactgatcgacgatgcgatccacttgcttgcggtcatagctcggttccttgccttctcctggcttgaaacgttcgccgtgctcacgtttggaatgggcgtcaagctggcggaacagactttcggtctgcgctttccacgccacacgaccgtgctgcgaaatctcccatgtggtctgcttgtccaccacggcgcgctccaaacgagcaagggccgcgtccacttgggcgatcacatagccgcctttgaccaaatcgaaagaaacattctgaatatcatgctgggtgagttgcgctccctcaccttcgtacagcatgtgcgcacgctcaagaaaagcgtccacctgttcggaatcatacccccacttgcgctttgaagtacgagcgatccccgatgcgttcctctcggattcaggttcctgcgccattggctatcgacctcctactgcactactcaacgtccttactctacgtgattgattcgacgcttttggctttcttgtggaaaattcagcgaatcgacactcaaatcacaccatttttcacgcatttactatggaaggaacccctattgggcagcgcgacacacgttgaagctgtcacaggcaacgaatactgtacagtagagctttgcgggcgattagctcagttggttagagcgccacctttacacggtggatgtcgggggttcgagtccctcatcgcccaccttttgtttccgcaaaaataagccgttccgactcttctgatattcccaactatctcgtgcgcgtgtcagcaaagtcatgacttttgtcaatatagacaattccatggaaacatcttcttcgactgcttccgcaagcaaaaaggcttggaatcatgtgattccaagcctttatatgagcgcccgaccttggccatgcgtgtcgaggcgggtaaaacgaatacgattagcggcctttgccgaatgcgcgcagacggatgccgttccagtcaccgctgacggtcagcggcgtggctgcattcatgccggcggtcttcgcggcggactgcacggtgcttgaacttgccgcgcccgggcgccccggcttcggggtgagcacccacaatggaccatcgtcgccgaggaccgcatacgcatcgacgatggtgtcagacagttcgtcttcgtcatcgccgtcgcgccaccagataatcacgccatcaacggcggaatcatagtcctcgtcgaccagctcttcaccggtcagctcctcgatcttggcgcggatcgagtcgtccacatcatcgtcccacagccattcctgtaccaggtcgccggcgtggaaaccgaattcttcagcgttatcagatgccgtttgattcacgttcgtcaatataccaacactgctcgaacatatacgttacgaaccgtggaattgctcactttgcgagattgttttttcttatatctcggaatgcgtcactctcccgcggagcattgcggcagggatgcacccttgccgtctcggacggcaaccagcgcatcgtacgcctcctgcaaagtggacaccttcaccacgttcaaaccttccggaatatgatccacaacgctggaacaattggattccggggcaaggaaccaagttgctccgtcgcgtttcgctccgagcatcttcaaacggatgcctccgatttcaccgacttcacctttgtcgttcatagtgcccgttcccgcgatgatcttacccccagaaagtttttcaccggtcaccttgtcgatcagaccaagcgtgtacatcatgcccgccgacggcccgccgatgtcgtccacatgcatggacaccttcatgccggacacgtcataaccatgctcttccaggaactttttcgccgctgcggtggcggaatcctgcgatgacgtcatctccttgtcgctggactgcttgtattcctctgcggtctgcccaacaggaaccaccgcttcctgaggcatcaccgtggatttcgaatcggcccacgccaccaatgcctgcgcgttcgacaccgggtaccctggcacgcctgaagcattgaccgtgaccaacagcagttggcctgaatccttatacgttttcgcaccggaaacggcgatgacctgcttgccggaaacctccccgagcacattctgtgtcgggccgggcacctgcaccacatacgcgctgggcataatcaacaccaatacgcacagtaccgccaccaacggtcctgcaagataacgccatgaacgcgcggacagccaaccttccgcgcctatcagccatcgtttgacacgtcccggagcgccgctacgtgtgtttttgccgtgaattcgtcgtgtttccttcatcttgggcatacctcccataacatagtatggaaccaaccaaacttgaaaaaacgcttaggaaaaggcagggccggcatggacgagaacgcgatccgccaatggtttatcgattgtttcggaccaattcaaggcgagatggcatggaaccagttttccaacatgccggaagagttgcgcgaccagttgatgaatcaggatgtgagcaagcttcccaagccggccgaggtcaggtcgatgatgcaggcgttcactgcgggcgggctcaacactttcggagacatccagcacatcaccgaggaaggtccaatcaacgtcaaactggcgaaatcattggcattgcagcaggccaatggcgaaggatcggaaaccagtgtgagcgcggagtacggcgagatggcccggcgagccatcagcgaggcgaatctgtggcttgacaccgcttgcgaattcaaccccgcgcaaggcgaaacgcaggtgcttacccgcgcaggctgggtggaaggatgcatcgattcctgggcgcagtttgcatccccgattgccgagtcgatgagcgacgctctggcttcgattttgtcacagcgtttcggcgattccgaattccatacggaaatttccggcattttcgccggtccggtgcagattccgattcccgatgatatgaaagatccggcaaaactcatgcgtttcgtcggcaatacgtcgttcgccatgcagctgggacgtgccgccggcgatttgtcgcatgaggtgcgcggcagtttcgaccaaagcatttcgttgctgaagaatccggctggaggcctgatcgtgcagaatgtcgtcgaatatgcgaaatccttggaaatcgacgtgaacgaagtaatgagctatcttgcactgcaagagctcgcccattcgcgcctgtacgcttccgtgccgtggctgatgccacgcttcgaggcgctgttgggcaagtatgcccgtggcgccagcatcgatttggacgccatggaggagcagatccgcgatgcgcagtccgtcgacccggattccatggccgacgcggtgaacatcaccaaggtggcgttccctgacacgcctgaacaacagcaggccatgaaatcgctggagaatctgctcgccttggtagagggttgggtagacaccgtagtgtggcgcgccggcatggctcatattccgcatatcgaacagcttcgtgagatgctccgccgcgagcgcgccatcggaggtcccgcggaacgcaccttcgaaagcctgatcggcttgcaattacgcccgaagcgcatgcgtgaagcggccgcattgtgggataacatctgcgctacggaaggcgcgcaggcacgagacgcgaaatggtcacatcccgatctactgccgcaactgccgaatgatgacgatgacaacacctcacagtcgcagaacaacggatcgtcggaaaacacggaaaatacgacgttcgccgcttccaatgccaccgatatggcgtcgcagccccttggcgacgccgatggcatgaccatcgattgggatgccgaactcagcaagctgcttgacgaggaagagcacaaaggcggcgaatccgataccaatggcagcgactctgacgattccgcagaatccggcagcaacaacgataccgacgccgagtaatcgcgcttcttccgttagcagtatcagcggaagaagcgcgacacccgtcgtgccctttcaccctcattgccttcacgggtacgcgcatatgagacgtcaagcgtgtcttcggcgcgcgtcacggccacatacatgagccggcgttcctcctcaagcacgtcgtcatcctgcggcaacccatacggtatgagtccttccgagcagccgataaggaacacgtgcttgaattccaaacctttggacgcgtggatagtggaaatggtcacgccgctcagatccgcgccgacgcccaatgcctccaacatggccagtctggtctgcgtgtcgtcggaaagtgcggaattctgccatccgctatccctgcgcacgcgatatctcaaatgctgttcggccaatgccttgcacaggattttctgctgcgcgttgactctggtgagaatcgcgcaatcggccggcgactcccccgcatccaccagtttgcggatgcgcgccgccacaccttgcgcttcctcccaatcgctgccatatatggtttccacgaccctccgtcctttgctcctttcagagctgagcttcagataatcggcccgttgcggcgatgccgcaagcacacgattggcatagttgacgatctgcggcgtggaacggtagtcgttgttcagattgatgtcagcggtgagcggaccgaattccgaatcgaagttgagcagactgtagctacttgcgcccgcgaacgagtagatggtctgcgccggatcgcccaccacgcaaatattgcggtttgagccgagccatcgggtgagcagacggtgctgcaatggcgaaacgtcctggtactcgtcgacggtaagccatctgatgttggagcggatagctgaggccacttcctcgtcgctttccatcagatgacaaacgatcagcagaatatcgtcgaaatcgatttcgttgcggttggttttttctgcctcatacgctttgtatacgtctacgaattggcttggttcgaggcctgatggcggctgtcgatgcgttgccgcgcaaacccgcgcgtaatcttccggtgcgatcagtgagattttgcaccagttgatttccgcttgcaagttacgtatggtgtcgtcatccacttggaaggtggtgacgcggcgcagcgagcgctccaccagttcacgtggatttctggaaatgaacggcatcggcccctcgcatacgtccggccacacttggcgtagctgatggagggccgcggagtggaaggtggctgctttgacgtcggctgcgacatcgagtttcgataggcggctacgcatttccgccgccgctttgacggagaatgtgactgcgatcgtgcttcgtggattccacgctttggtggcgcacgcataggcgattctgcgggtaacggttcgcgtcttgcccgcgcccgcgcccgcgatgatgcgcactggaccgtccacggccgttgcggccgccctttgcgcctcatccaatccgtcaagaatctcttccgctgttgcactcatacgttccattgtggcagattgccatcgccatgtgacgatttgcccgcggttcacctgcagttttactggcaagtcggcaacgcttcgcccctattgtgtattaaggttggaattgtgaccgaacgaagcaaatttatgatagctgccctgacaagtgcggcgatgccgaacgccgccattgcgggcgcgcgtgccagcgaacagaccaacccgaccgacgaggggtacggcgtcgaccatgccgtggttcaggatgcagcgggcaagctgtatgacgtgttcgcatccaacacgcctgaaggccgtaagcgtcttgccggtcgcgtgcgcgctgcgcagacgctctcgcaagcccgcgaattaggcggattgggttttgccgtcgatagcatagtagctttttcaaacggcgatttgaagcattccgccactggagatacgtccgtgctggtggccacccaccatgtgggtcaggcgcggccgttggagctgctgactttggatgattgttccagcgtaggcaccgctttgggcgcgattcatcgtcttcgtcccgacttcctgcaggaagcgggctatccgacgtttgtcaccggccagattcgcgctcagctgaccgcttggatcaagcgcctgcgtcaggctggtcatgttccgcaggagatcaccactagttgggcgaatattcttgaaaccgacggcctgtggtcgttctccacttgcccggtgcatggcgggttgcgtgacggcgatgtgcttttttccggttcgtccatcaccgcggtcacgaattggcaggatatgcaggtcaacgatcctgcccgcgatttggcttggattttcgccaagcttgacgagaaccaccgcaatgccttgctttccgcatacggtcgcatgttgggcaatcgtttggatgatctgattatgctgcgggccaatctgtggctgcagatggagcaggtcggcgattttatttccgctttgaacaaggcagacaacgccaagattatgcaattcaaggcgcaggtggaacgcctggcccaccagttgggtgtcgccacagcgaagaatcgcgtgcaaactgaaacgaagcaggagtccaaggatcgcccccagcgcccgccgagcacaatcaccgtaggcacgttgctgaacgaatcggagcgtcgccgtaacgcggccgcacagcagaatgattccgacacgaccggcgaacgtcatgttgacgctgtggatatggatgattccactggcgatttcgacgcgaccggcgatttcgacgtgaccggctcccagccggtccgcaagacgaaggaaatcgtcaacgacgcgacggaagcgttcgcaccggccggaacccagcaatcacaagcaccgtccggcaatacgaatgaacatgaggcgacctcggtcagcactttcattccggaacattccgcaaaagaacggcacgaatccatgccgtcaagttccaccatggtaatcagcaggctggaaacggccgacgacaacgacgatacgaacgaggaatcgattcccgcatcgcacagcgaggccgcgacagtactcattccactgttggaacgagatgaggcgaccatgcagaaagcgcaggcgcagatcaatcagtgggaggcggaagacgccaccgatgagaagccacgcgtagaataggcgcacataacccgtacatacacgtgcgcatgcattgcgcattatcacgaaggagcatccatggatattgaactcggcattcagaatgtggcccgcaccgtcaccttcagcaccgaacagagcgccgatgaggtcaacgcggccatcgccgacgccgtggagaacggcaagaccatcaatctgacggacgacaagggccgtcgcatcgtggtgccggcaggctcgctcggctacgccatcatcggttccgaaaccaagcacgccgtcggtttcggcaacctctgacccgttcgcatcaccagatttcagcttcgaactgaaacacacgttttcgacgtcacaagaaaagccagacgttcacgtctggcttttccattttgggcgatcaactcgttcctggtttcatatcgcgattacgcatcgatgattgcgtttcggttttttattttcgccttcgacgattctttgctcaagtgaacgcctcgattgatgatttcctgaaccgtttcgtcgctggtgaggttctcccccagcgcgttcggcttgcctttgccgtgccagtcggatccgcctgttaccagcagatcgtgccggcgcgcaatggtgagcagacgttcacgctgttctgatggattgccgcgatgccacacttccaaaccgtccaagccttcggtgatgagagattcgatttgccggtcggtcagtaatgtccgattgcgccgggggtctccggcgtgggcgataaccaccaccccgcccgcacccttgaccgcggccaccacgtcgtgcgtggtcggtgatggcgtgggaatgtaatatttcgacgttgcgctcaccgcatcggcgaaagcgtcggatcgtgtttcatatacgccggcagccaccaatgcgtcggcgatatgcggccggcctatcgtggtgcgtttgccttcacgcacctgcgcgagcacatcatcccacgtaatcggaaaatcctgcgccatcagttcgaccatgcgcttggttctacgcagtcgcgcctcgcgggtggacgcgaacatctcgctgatatcggcgttcagcggatcatattggaatgcgagcatgtgcacggatacgctctcatcgacggcagtgatttccgtaccgcgtaacaacggcaatctgacctcccgcgaagcagccaacgcatcctgccaaccggaggtcgtgtcatgatcggcaatcgcaacaccatgcaattgcaatgctctcgcttcctgcaacaacgcacgcggcgtttccgtaccgtcggaaaaaacggtatggcagtgaatgtcccaaccttcagcgggcggtgccgcagtgcctacgcgaatcatgtatccatcgtaagctgtttttggcgcgactcggcacaataccgcgtaaactaggcgatgacaacgtttgtattttgattcaaggatgcacgatgagcgatttttccggcgaacaggttgccgaagccactctcgacgatgattatacgaagccgcgcggttggcggcataccgcgacatggacgtatctagtcatgctgatcgcctcggcggtagcgctggtcgtatcgttcgtgctttccgccgagacactgaaattggcgcgcaatcccggtcagaagctcagctgtgatgtgaatgccgtgatgtcgtgttccacggttgcggaatcgtggcaggctgaggttgtgaagttcgccggtttgagtttcccgaatgcgttcttcggcatcgccgcggaatcagtgttcgtaacgatcgcggtgatcggtttgacgaaggtcgccgtgccccgctggtttgcgttgtgcacatggctgggtggattggccgcgctggcttattcgtattggctgacctcgcagtcgttgtttgtgatcaacgcgctatgcccgtggtgtctgtgtctgatgttctccaccaccgtgcagttcatggcgttgtctcatgccacggcggtggttcaggagattccggccaagcgcgagggcgtacgcacctactaccgtcttaattacgatctgatggtcgatgccttatggatcgtgacattgattgtgatcattctcgtcgaagacggccccctgctgttcagttgacgtcaagtaacgtccaatcagcagtagggattcactcgcctacaagagaagccgactggaaacagccggcttctttcttttgcgtatccgcaaatttcagtgttatgcgcaaaaccttacagcagttcgattttgccgacgatggtggccgatccggtgagtttcacgtcgttatcggtcacgtcgacgcgcagggtgccgccacgcacggtgatcgtccaatgatcgatgccggttttggcacgcaacgtgatggcggtggcgcacaggccggttccgcacgacagggtttcgccgcagccgcgttcgttgacgcgcatggtggcgttgccctcgttgtcgccttcgctttgctcgtcgatgcgcacgaactcaacattctggtcgctttcgattcggggcgcgaccaccggcttggtcaccaaatcaagctgttccaccgtcggcaggctggagaacgcgtcttcgatgacggccaccacatgcggattgcccatgtccacgaacgtgccgcgtgcggaaccggccgtgccgggaatcgtcacttcgtatccatcaagatcgccacgcttccatgaacccatctcaacctggaacacgtccttgccaagagtcggcacatcgccaagtgaaatcagaaccttcacaccggcacgggtgccgagacggaacggttcaccgcccggctgaccggcaataccctgccgttgcgcgaacagagtgatcgcacgcgtgccgttgccgcacatctcagccaacgaaccatccgcgttgcggtagtccatgaaccaatccgcattgtcggcagcacaaacggcaatctgcttgtcgttcaaatcggacaccgcctgcggatgagtaaggcggatcaagccatcgccaccgataccgaaatgacggtcgcacaggaatcgcacttcatcggcggtaggctcgtacgtgccttcggcgtccagatacaccacgaaatcgttgccggtggcgtgtgctttgtaaacaatgcttggaatgctcataccgattcactctacacgcggtaggctattgaagaagttggacgcaacacgtgtgcattatgttgcagtatgtttgcgtgcggaacaagggaggacgtatgacttcaacggcaccaatcggcgttttcgattccggtttgggcgggatttccgtggcgcgcgaaatccgccgcgatatgccgaacgaacgcgtgctgtattttggcgattccgcgaacgctccgtacggaaccaaatcacctgaacaggtacgcaagctgtccgacgccattgtgaaacgtttcgtggagcagggagtgaaagcggttgtcatcgcttgcaataccgccacttccgccgcagccaacgagttgcgcgacaaatacgacattccgatcattggcatggaaccagcgctgaaggtggcgtgcgatcgaggccatggcaatcgtcagcgtgtcatcgtcgcagctactcccctgacgttgcgggaacgcaagttcgccgtgctgatggatcgtttcaaaacagaccatacgatctttccggaaccctgccccggtttggtggagatcgttgagcacggccaactcgacgatcacgatgttgtgatgcacacgctgcaccagtatttcgaccagtatgatttgtcgacgatcgattcggtagtgcttggctgcacgcatttcgtgttttaccgcgactatttccgtgaactgctgcccgacacagcggcaatcatcgacggcaacgaaggcaccgtgcgccatcttggcgtggtgctcgaatcgttgggcaagctctctccggaagacgcggaaggtggcatcgagctggccaattccaacacttccacgcaaatcgcacaattagcgcaatcactgcttggtcactgaccgcgaatattccgatagaccgcgcaaagccaattgaaacccgcaaaaactgctcaaccgttgtcagaagtacaacgacgaagtggcgctggccaaggaatacgagcaggacggccgcgtgctcatcctcgcgccggaaagcctgtacggcctgaacacgttgagcaagtcgttcgaaggtttggaacgcatgtaccgcgcgggctatgcggcggccgaggccatccccgcattcctagaaagctgaagataacgtccatatccaacgcctgccagcggttcgttttcaaattgagacatgacacgaaaattttataaaactcccatattatgtcctattgttttttcgtcgacataatcggcggaaaagtcgacattaaaggagaatgaaatgaagaacaacacattccggcgtctgctggccatggccgcggcgggtgccatgctgacgtcgatcgccgcatgcggatcgtcttccaacgatgacacagcctccaacggctccgatagcacctcgctgatttcagtgaacaacagcgaaccgcagaacggtctaattccaagcgacaccaacgaaatgggcggcggcagagttattcgatacctgttcgaaggtctggtgagcttcgacgcaaagggcaagcaacatctcgaagtcgccgagagtatcaccccgaacgaggatgccaccaagtacacaatcaagttgaagaaaggctggaagttcaccaacggcgaggcggtaaccgcccattccttcgccgacacctggagtttcgccgccaacgtgaagaacgcgcagaagaccgcaagccgattctccaccatcaagggctatgacgaactgcaggatccgaacgtcgatccgaaggccacactttccggtctttccaccccggacgactacacgctggtcgtcgagctgaacaagcctgattccgtattcccgaccaagctcgcgcaccaatccatgttcccgctgccaagcgtggcatttaaggacatcaagaagttcggccaggctccgattggcaatggtccgtacaagttcaagtcctggtcccacgacaagaacatcatcgtcgtaccaaacaaggattataagggcagccgcaaggtgtccaacaaaggcatcgaataccgcgtctacacgaatgaggattccgcttactccgacgtgctgtctggcaacctcgacgtgatggatcagattccacagtccgcggtgaagaccttccgccaggattccagcgtgatcgcctacagccaggcaggatcctcgttccagtccttcatcattccggaacgtcttgagcatttcggcaacgacgaagaaggccagttgcgtcgtcaggccatttccatggccatcgaccgcgaccagatcgtcaagaaggtttacaacaacacgaagaccccgaccaccgatttcacttcaccgctcgtccccgaatatgtgaagaaactggaacagaacggcagcaacctgaaatacaacgcttccaaggccaaggaactctggaggaaagccaatgccatcaagccgtggtccggcaacttccgaatcgcctataacgccgatggcggccataaggaatgggtcgatgccgtgtgcaatcagatcaagaacacgctcgacatcgacgccgctggcgagccgtacgccacgttcagcgacgtgcgtaaccaggtgaccaaccgcaccatcaaaaccgcgttccgtgccggctggatgctggattacccgtccgctgaagattatctcaatccgctatatgcctccagctccgctgacggtcatggttcgaacgatggtgattacaagagtgcggaattcgacaagctcctgaatgccgcacttgcccagaccgacgtaaagaaacggaccgaggacttcaccaaggcgcaggaagtgctggccaaggatcttccagtgattccgctgtggaacgacaacgtcgccgccgcgtccgcgacgaacgtgaagaacgtatcgttcgattacaccaatctgcctacctacaacaccatcactaagtgatgtttctggccggcggacgaacgattcgccggccatatagggagctcaagtacagtggggttcgaatccttcatggattcgaaccccactgtacttttgtggcttgttttgccggtttgccactacggcatcaactctgcacgtagctgcccttcggagacttccaaccgcagttcatcatctcgctattgaacaccattgcgccttcaccatgagccggaacgacgatcataccgccatctccatgatgacgggcgacaccatccagcgccgccttcgcagcctcgatcggctcctccttggcgtacagaacacgatcggaaacctgatgcgcagcgacttccttgacgaacgcttcaccgatgccggtgcaggagatcgcgacggaatcgttgttggcataggtaccacagcccggcagaggcgaatcgccgacgcgtcccggcatctggttggtgatgccaccggtggaggtgccggcagcgatgttgccggacgagtcacgggcgacagcgccgatggtgccatgcttctcccattcatcgccgttggattgcgcctcgcgcaaggattcctgacgtgctggagtgatgaaatattcactgtcgcacagttcgattccccactccttaagcaaatcattaccgggcttggcaaacatgacatgcttggtcttttccttgatggcacgcgctacgttgatcggattcttagacgtggtcagaccgcacgcggaaccgacctcgccatcgacaccggtcatcaggcaggaatccatggatacgatgccttcgctcgtcaatgcagcgccacgaccagcgttgaactccggagcatcctccataacacggatagccgcgcacacggcatcctccgccggcgccccctgctccagcagcgcatagccagcttcaagagccctgttcaaatcctgctccacctgggcacgacgttccggcgtatcctttttgccacgattgccggcacccgcgtgaatcaccagcagaatcccgtccggatcagcttgggcgatgtggaccgtcgactgaggcagtgcagcttcgttcattgatatcttctccactccatttttattgattattcgcagatatcttacgtcgtccttcgataagaaatgaccgaacacgcagaaatacgtcaattagaccgcgtaaagtcaattgaacccgcaaaagagacggacggcgaaaggacggggcgcatatggctcacaggacggcaatgatcgacgtcggcggcggtttccgcgcgatctacggtgcgggcgtgatggaccgcatgcttgaggacggcatcagcgtcgaccactgctatggtgtttccgccggcagcgccaacatggtttcgttcatcgcgaagcagcatgggcgcaaccacacgttctacacgcagtacgcgttccgcaaggaatacgcgagcttcgacagctatgtcaagaaccataatttcgccaacctcgattacgtgtatagcacgctcagcaatcatgatggcgaaaatccggttgactacgcggctttcgaagccaacccgaccggtttcaccgtggttgcgtgcaacgccgaagacggctccacgaagtatttcggcaaatccgacgtgggctacgacaatttcgacatcctgaaggcgtcatcagcggtgccggtagcttgcgaaccgtatgcgatcgatggcgtcccctattacgacggcggcatcgccgatccgattccggtgcagaaggccatcgatgacggctacgaccgtatcgtggtgatactcacccgtccgaaagacaccgtacgcgaacagaagagggacatcggcccggccaggattttgaagcgcagccaccccgaagccgcggaaaaactgctcaaccgttatcagacgtacaacgacgaagtggcgctggccaaggaatacgagcaggacggccgcgtgctcatcctcgcgccggaaagcctgtacggcctgaacacgttgagcaagtcgttcgaaggtttggaacgcatgtaccgcgcgggctatgcggcggccgaggccatccccgcattcctaaaaagctgagcactaccctcatatgaacactccagccgatagcaacacgcgtgaaaacgccaacacgaacaccgacatcagcatcaccgcgaatgccacgggattcagcacgaaaacactgaacccgcagattctggtgaccttgtggaacgtggagcgtttgggctcgttctccgcggtcgcgcgtgaaaccggatggtcgcaaccggccatcagccagcagatccgcaagatcgaacgcgaacttgacgcaaaactcgtgcagcgcacgtcgcatggcgtggaattgactccgatcggccgtattctggcacgtcacgggcagcttatcgacaatcgcgtcacccaagccgtcaaagatgtggaagagtaccagcgcaacggatcgacgcatattcgtttggtcgctcccccatcggtatgttcgtcgttcgtggcacgcgtgctcgtgcatatcagcaaaacgtccgacattcgcgtgagcctcatgcagatggagccgcctgaggccatggaggcgttggaacaggggcttgccgattgcgcgatcatcttccaatacaattcactccccgctttggccggaccggacgatttggaagtcgctcctttcggtgtcgatccgctgatgctgctgatcggcgcgaacaatgcgatcgcgcgccagtacgaaagctcgcacctgccggtccaattggtttcggcacgcagcgaacagtggatcgccggctgcgaaacctgccaggcgaatctggtgtcgttggcgcgtgccgccggcttcacaccggaaatcacacattcgaccgacgatttttgggccacgcagaatctggtggaagtcggcatgggcgtctcgatcatatctcgcttagccacaaccgctggaatccaacccgatttggccgcactgccaatcgccgacaacaacgcattccgcacagtctgtttcgtcacaagaaaagcggacgaccgaccggcagtgacccgcgtcaaagacgaaatcgaaagggcgtcacaccagtatttggaaaacatctgattcgcttctgattccctgattgcggaatgctgatgcgagcgaatgtttcttgtatttttcagcatcgacatgatcagattaataattgaatagcaaaagcatctgatataagaaaacttcataacagtcttcgtattcaacacaagaacacactattcccgcaaccaacggtacggcatgctggaaccatggaagaaatcacggaaatgaagcatcgtaccgattccggctttgacgccgacgccatcgaccacaccaccgcagccgacctcgccgaagttggctccgacaaatggacacgctaccccggctgcatcggcgcattcatcgccgaaatggactacggcctagccccatgcattcagaaagccatcgacaatgcctgcgatcattgcaagctcggctacatcccagaaccttggaagcagcgcgtggcagaagcctgcgcagactggcagcgctcgcattacgggtggaatgtggaccccagtatcattcgcgtggttcccgacgtgcttgaagcgtacgagattttcctgcgcgaactggtaggcgctggtaatagcgtaatcgtgccaacgccggcttacatgccgtttctgagtgtgccgaaactatatgacgtcaacgtgatcgaaatcgaaatgctgcaaagcggcgacgccgaaaccggagaggcgcaatgggtgttcgacttcgacgccatcgaacgcgcgtttgcggccggatgccatgcgttcgtgctctgcaacccgcacaacccgatcggcaaagtgctcaccttggaagaggagctgcgtctgagcgatcttgcggcacagtatgacgtgcgtattttcaatgatgagattcatgcgccgttcgtgttcgaaggcaagcacattccgttccccaccatcagcgagcaggccgcattacagtcgatgaccgctaccagcgcgtcgaagtcgttcaatattccgggcacgaagtgcgcgcaggtgctgcttaccaatcctgcggatcgtgacatgtgggcggtcaaggcggagtggagcgaacatcagaccgccaccatcggcgcaatcgccaccaccaccgcatataacgaaggtgatccgtggttccaggacgcgttcgcctacgtgcgtaggaatattgccctgttcgatgagcagatgcgtgagcggttcgccggaatcggctatatcaagcctcaaggcacgtatatcgcatggcttgattttggtccgcttggcatcgaagacccggccacatacttccttgagaaagcgcaagtggcgctaaccgatggacgctcatgcggcgaggcaggtgtcggatgcgtgcgcgtgaacgtggcaatgccctatccgctgctggtcgaatgcctggaccgcatgttcaacgcattgcacgccgacggattattgtaggatccgactcatacttcacattctcttcgaccagcggcagcatgacggtgaacgccccctcgttagaacgagaaggcttataaagcatattgctttaagtaaataccccaagagtacggcaacactcttggggtattttcatcaggcggaaccccgccaaacaagttcgaataaacaaaatcccggccgcaaaagcaaccgggacaatgttcaagcgtcaacgagatcgcgcgctatcgcatggcgtatcacgtcatcacgcccaacacccaaccgcctagctttcgcgtcaaccaacgccaacatgtccgcggaaacacccaacgagacaatatcgggataatcggcgtccactggaaaataggaccatgcatcacaggtcccctacttccaccgtaatcgccacgttcggcggcttcgccccaacggtcaaactcggcatcactaatcacaacacacctcccactcggtaacttcacgcaaaaacttagccgtggccggcatagcatggaatataacccaatggtcaacgtcgtttcaatccacgctctccgtgaggagagcgacccggtcacgcttcgcttgaccaaacggtctaaaaatttcaatccacactccccttgcggggagcgacctgtgcacgtatccacgcacgttgtcgacgaaatttcaatccacactccccttgcggggagcgaccgtccaaggagacatgcatcctgccgtccgtgtaatttcaatccacactccccttgcggggagcgacggtgcgtttcgagcgtcgtatcaatggtacgcatgatttcaatccacactccccttgcggggagcgacacgccgtccaccctttttcggtgagcgggtcgatatttcaatccacactccccttgcggggagcgacacgccaggcatggcaaacctcgccttcaaatgggaatttcaatccacactccccttgcggggagcgaccgaagcgttcggcgcgccggtccagtacgtgtaatttcaatccacactccccttgcggggagcgactcaattcggcggcgccactattgaaaccggacttatttcaatccacactccccttgcggggagcgacccgcatggacgaactctgccgcgacacgatcaaatttcaatccacactccccttgcggggagcgacaaggcttgttctgcatcgattgggaatccaacgaatttcaatccacactccccttgcggggagcgactttcatatgtttcctccttttgatggttttttatgcatttcaatccacactccccttgcggggagcgacacgtgccgccacgataagtaatcacgtccatagtatttcaatccacactccccttgcggggagcgacagtgccagctggccttccgcctgaggaggtaatatttcaatccacactccccttgcggggagcgaccgaccttcaggatgcgtttggcttcatccacggtatttcaatccacactccccttgcggggagcgactcctggcttttggtgatcggaagtcttgagaccgatttcaatccacactccccttgcggggagcgacacatgacgatgtgtgggattattcaacagaattgatttcaatccacactccccttgcggggagcgacctggtcgttgacgttgctgcgggtctgctggatatttcaatccacactccccttgcggggagcgaccgtttgcgttgcgggagccatatccacaacattcaatttcaatccacactccccttgcggggagcgacttggcggcaatgccggatagggtgtctccaggctatttcaatccacactccccttgcggggagcgacgtcggcggcggccaccgccctgcgcgcctgggccatatttcaatccacactccccttgcggggagcgacaccgcatacaaggccatgcgccaggaacgcaagatttcaatccacactccccttgcggggagcgacctgcctgacaggcagaccctcgaggtcaccgacctatttcaatccacactccccttgcggggagcgactctatcgaatgcgccggtttgatgatgcgatcatgatttcaatccacactccccttgcggggagcgaccctatcgaatgcgccggtttgatgatgcgatcatgatttcaatccacactccccttgcggggagcgaccctcaccgtccggctgatagtcgctccaatcgtatttcaatccacactccccttgcggggagcgacagctcactgattttctgcaaatgacaaacatactatttcaatccacactccccttgcggggagcgactgggggctacccgaaccatacgacggcaaatatatttcaatccacactccccttgcggggagcgacacgagtgcgacgatgatggcgcagatgccggtgatatttcaatccacactccccttgcggggagcgacgccatgaatctttggagcggacacgtcaacaaatttcaatccacactccccttgcggggagcgacttccatggcaaagtgaaatcagcgatatcagccgtatttcaatccacactccccttgcggggagcgacgaaaatatctcaaggaacctatacaagttgtgtgatttcaatccacactccccttgcggggagcgacccggcagtccatacttggccatggtgcagtcggtatttcaatccacactccccttgcggggagcgaccaacggcagatttttaatgcctaacgattggtaatttcaatccacactccccttgcggggagcgacccgccgtctgctgtccggctgggacttccagtatatttcaatccacactccccttgcggggagcgaccatcgggtctgttccatattgtaacaccgttgctatttcaatccacactccccttgcggggagcgacgccgaagcgctgtaagcattgttaatctggtcggtatttcaatccacactccccttgcggggagcgaccaggttcaccctcggggatgctcttgccgtacggatttcaatccacactccccttgcggggagcgactgtccacattaataatcgcctgccggtactcttatttcaatccacactccccttgcggggagcgacgccggcgtcggtggtgaacaacgcgcacggggtatttcaatccacactccccttgcggggagcgaccggtttttcaataaaatcaatatcatgatgcttatttcaatccacactccccttgcggggagcgacgtacgccaacccccagcaaatggtgttgttgattatttcaatccacactccccttgcggggagcgaccttatgatgacacgcaatacacgcgttgctgcaaatttcaatccacactccccttgcggggagcgactttggtgtcgacgatgccgtaggtgtcttgacggtatttcaatccacactccccttgcggggagcgacataacgttgacgcccgccgtctgctgtccggctgatttcaatccacactccccttgcggggagcgacgtgactacgttaatgcttgtgccggcgttggtcgtatttcaatccacactccccttgcggggagcgaccgcagaaatgagacatttttgaccaaataataattcaagcaaaacctcatctcggctgatacacatattacatcagttccccgccgacccaaatacgtccaaatgcaaagatcaaactctatctgactacacttttcgattatcaaacaacaatccgaaattacatcagagttccagttttaatttcctccgcacaaaaaaggtgcgaacctacctgtaactcatgactgcttcagggtcgcactgcatgtcgtttagaagtcataccatcatgactccatcaacgggaacatgacgttgaacacctaagtgttcaatgcgccgtgaatagttcgttcccaaattgtaatatctcaaactatccgttttgacatcgatgatgctcaacagatcatgcttaagcgtaagatactccgcagaagtaacgctacattcgaaaacgctattttgcacgcgttgcccatatttcatgcagctttttgccactaaacgtagacgccttttaccagcggatgtttcagtattcacatcatatgtcaccacaacaagcatcagtcatctccttcatcagcggcttcacggcctatcacttccacatgaatggcgggtaagcgtctatatccccacgaatagctcttgccagcaacaaagcttgaacatatggaatcaagccccacggcatcttttctcccaagaacggatgagtaatcacttcttgtttgcgcttctgccaagcagccaatacggttttccgcccagcgtcattaaggaatacgccaccattctctcgctgctcaaaatcaccagctgaaatactcccaagattgaccagagttagcgcaaatcgatcagcaagagcaggacgaaactcctccatgagatctaaggctaaggacggtcgaccaggtcgatctacatgcaagaaacctacatatggatcaagccccaccccttgcagtgcagcaaggcaatcccctgtaagcaaggagtaggaaaacgacaacagtgcattcatacgatcaagtggtggcctgcgactgcgctgttcaaagaagaaatcatcttttgagcggagaatcaaatcgtcgaatgcatagaaataatccttggcagctaaaccttccagacctcggatggcatcaacatcgttgcaaccagacacctgctttagatatccagacagagcccggctttgaccgctaagcctttcaacattgacacgtaaattatggtcacgtttggtacgctccagcacccaacgactgttgaaaatctttccaatgacaaaagaacgagcgaatctagctgaggaatctgtatcatcggcaaaacggtactgagaacgccgcagcaacacattacgattattctcaccgagaatcgaacaaaggtatctgcctctcggcgtataaaaagacaatcccgtgccggtctgcgcacattggcccattagcgcaggagatgcacctttgtaggagaaactcaaaatctgttccaatgaacgcagtggaatcttggccaatgccgttttatcacgttgcacgacaacattgtcgttctccaatgagagataaacgtcttcactggtaacaaataaggtgttcaacaattgcttcatgacgtttcctcattcacgtaagcatgtatgtactgctcggccgattttgcttttaacagctccggcaggcaaatgtctttcaacgaacatgcgctgcatgccttccgcggctttacgcgaggagtatgtcctctcgaaaacaactggtgcatttcttgaaccatggctaccactgtgccacgaagttcctctgttaactccactcgttcacgtcgccgtgtccgctgatagaacaaggctccttcaacaatctcgcatgaaagcatttcctccaggcacatggcttcagcgcacagttgcagacggtcagcatccacggttttagattgcccatgcttgtattcgataggatatgcgctccatagcccattcctgccctgtagaggaacaccatcatcggactgatggaattccacgacatcacaagcacctgtaagaccaagatgacgcgagaacacacgcaaatctcgcataatgagggcatctccacgagattcagactgctcataatcatgcgcacgctcatgctcaagatgaccggcagtggtgagatagttctcctgccactgctgctcaatatgaatcaacgcccactgccggcgacagaatgcaaagtgctggaggccagacagggccagccagtcttcttctggatattcgctatgccctgtcatagtttgctcctctaatcaagatgagtcgcttcagcgaccttcaagaatttcgtattccagatttggaatctcgctttcgtcaacagtcactatgccgtctgcagtcacatttacggcacgatgaaccttggccgaagaatactgaccgcccttgcaattatgcgtaaaccacacaaccttcagcacctccatggatcccgacggccgcgcagagctctcatcattctcgaaaagagtggtcagcgcttgcttgattttttcagcgtcttcatcggagaaaccagtcttctgcgccagctgagcgctgatgctgccaaatgtcttgtagacttccctacctgaaacacgatatttcatgcccatagtggcggaatccttcttgccagaatccgtcgtctcgctgttgaccgacttggtgatctggacgtcatcaatcgcaattggttccaaagaaaatgctgattggatactcaccggaccacgcacgcccaatgagaccccgtcgacgtccttacctttcttgaaagcaaacacctgaccgaacgcacgcacgtccaaccattgaccacagacctcatcgaacaccacattcttctgtttctgctcatctttggtcaacgtcttaagatagtcattgaagcgagcagacaacgacggctcctcatcatcggcccgatctgacgactgaacgaaaatcgtttctcccttgtcctgcagacgattacggattttccgtttcaatgcgacatcagacacctcaccgaaaccatcggatgtggttcgaggacggttgccgttgagaggatccccattgggattggcattcgacacggcaaacaccagagcgaaatcgattttcttgctgagactggtcattgcgactccttaatagaataattggttggtgaattgaccgtgtgtgtcaattgttgttttctcggtttttcgcttccgccgcgcgttccaaatatcgacgctgatgggaatagccaagcaaaaagagcggggacaacggccgattgtcttcataatctcctgcatggaacaaagacataacctcatcaacgtcattctggaaccatggagctccattagcagccttgaggtagggaaccaattgtttcatcaatgttccccaagtagcatatggttttgatgtgaaattgctcatcagcttgaccgcattcgtcggcctcgtgccgtcaatgccttgcttgtacatcgctctatgctcgaaatgatctgccaatgccaacaatcgcccgtatagataatctcgatctgttctggcggcatccaattccatggttacctctttctgttcaggattgctattgctttgcgttatgaaatattgcttccacaggctgcaggcaatttccaactgtctgttccacgtcttcagatcggcatacccaagcggcctagtcaccttgtgatacgaagcgtccagaatggaacgaggcaacgtcttatccccgaacatgcattccaccaatcgcttcttcacattcttagcgaatcgcttgtattcatcactggagcgatcggcgatatcgctcgcgcaactaataatgtcgttgaaagacggagcaccaatgaatcggacgacttttgtcgttccatccgacgtatcgatatgcgtcagatgccatgccaccgactcatgccaacgcatgatgctttcaatatattcactctcctgcaactcccgatagaaggtgacgctgagacggccagatgtggcggcgtccaagatggcaatcgtcatcttgctattgtgccgtttgaggaaattaccgttgccgtatccacgaagaaacttggaaaagcgctcagcataatcgatatccgtgacctgagctgcatatactacaggattcacggtttcgtcatcgatttgaggaaataactcttcaaaggcatcgcaagtatccttagagtccatctgtggatcgacaacaagttccacgggatgatcaatggaccagatgatgatctcctgagaacctgtcttcaaaccatggttattcgcaagccaacgaagcgtcacatatagtttttgcacagtgtcagcgtcaagccatagagcttctgtcttatcaatgaagcgtccacgaaaagtgcagtttttgtcatcgttggctgatatcaattttgcattggcggcgccacttgcagtcacgatattcttgggataattcatcgtaaagttttggaaggtacgaccaaacatatcaaaccctccaacacctatttttttgcctcgttcatgctgatagttaatccaacgattacgcagctcatcgtcttctgcgacattcggattgctttcgccgaattgaacatggaaacagacgccggcagctttgtctttgcttgcactcaattgcaacccctgccgtgtcgcatcttcaatgatgctgttctggctaacatagcgataaatcgcattgagcttgacgttgtctccacgccagttatctaattgttcaaggtacttatccgtacgctgtgaatcacatgcgctatcaacgtactgaagttgatcgcacaatggatgcggtaccggctgggtccccgaccttcccatggattcctctgtacatgggatgattatccaccgcccattctttgttttttcgatgggtgcgcaaagattcccatgctcatctaaagtaacatcaatcgttacttttaaagtagtgtgataaagtggcaataatgctttaagcacaggatttccaaggtcatcgggtgccccagacggtatcagacctgtcgcaggcttgataacctcatgcgtatccaaaagattcgaccatagactcatgattcctcctgcgcaacgggactcatgctgttaccgataacaaaaggtttgacctgccgatttttgcgaatgacccgtcggtcaagcgcctgtgactcaggccgaggaaactcgatgactccgtcacacatcgtcggagcccaaaaccttgcgatgaaatcatggtccgggttctcatcgggataaataaacccatgaaacatatatccgagactccaatcaccgtaatcatcatagaacccttcaccagagccgaactcgcatggttcgacatatccctgacattcacgagtgccgaggaatacatcgcgtcgccctccccgttccaccgaacgcttggcaatctcatgatgcttgttctcattacggtctgctgcaagatcctcacgctgctcattccactcgaaatgagccagcacctgataacttacatctttgagataggtgtagtaagaaagatcgttcaatactcccttcttcttcggctgcatcacaacggtccggatacccttgccttccgtctgaatcttattcatgactcggaccgcatcgatgacccatgtgatagtcggcttccagtacacactttcagtgatgcctttcaaagcctgatacgttggtacctgataggaatatttctcaccgcccacacgggttaccacttcggaaaataaggcatatctgccatataccttgtactcaatcgaatttcgatgtcgcttaatcggaacctccacggctcctcctttcgcaatggtccctgccgttgttttcgtccaatcatccaacgtctgaacggtcaggctggaatcatgtcggatcggacacgttccggcgccacatctatattccccggccatgtcggcgcgccagccacaagccgaacctgactaaacaaggcatcatcgcgaagcgctttgaacattccgtggtcaagataaccggacatatcgaatatgcccgcggctccatcggaacatttcatctgcaaccgatatcccggtagaggcctgcactctgtcacatcgcataaatagtcaagaaatgacatcatccctcctcatctcaatggatctatgggatacggccgctcgccatcatgagcaatatcccacgatgcacgaagctcatcctcatgcaaagtggcccaaccgacgaacagccgatgctgtttcttgggtaacccgcctgagagcaactccgtccaaagaatatacggccttattcccttgatattccacatgaacatgtggaggattatggtcatcggcgtacatacggacgacaatcccgaagaacatgctgattatcggcatcatcgtcacctccctgtcatcacatacaacattttagcgaagtcttcgctacagacatgcgctcttcttaatctgctcatcgattttccgaccattgcactcgatcaaccgcaccagttacacgaaaattccttcctggctgcgatcaacgaccacgccataacgctcgtcataatgcgccgtatccaaggcatacacaccgaagttatcatcggccaagtagatcgcgcctatctcactgagcttcttgaaatcatggtcgaaaagagaaactgtgtattcttgaagcttcctcaatgtccggatacgggcgtcccaatctctccgagacaattcgtcaagcaaatccgacgatcggccataggacaccaccacatcatgcccgcctcggacaatcacatgaaaagagttccctaccgttttgaaagactgtgcgaaacaatagggatatttcgaatgagcattgcttctatgagcgtaattccctcttcccaatagattggttgaaagcaaatcatatgctgtgtttcttacatcaattggataatccatggctccatgtttctgccgcttaaggaagtatcgataatattcgtcgattattttctcatcaagaaaatcttcaccaggatgttcacgggcaagctgctgagcgatgtccttacctgtttggatatccggcaacatggagagattctcgcccctgatggaatatacaaacacatccttcggcgttgcggattctccgttcctattgcaccgacccgccgcctgcaggatactgtcgagaccggtcatggcgcgaaccacacacgcaaaagacaggtcgacaccagcttcaatcagctgagtgctcacgcagatcaccggcttctgtgtggcaagcatttccatgaccctatttagggcatcggtacgatgtctgccacacatcgaagtactcaggtgtacaagcttgaattcactctccgcatccagatcgtgcagatgttgaaagacatcacgtgcctctctcttcaaatttacgattgccagacaatttccatgctcacgagcgtgtgcgagcaccgcctcagcaaattccaagcaatctttatccatgttgtcccccggcataacgatattcgtacgcctgagcttgttgaaaagcttcaagtctccgctaatcaaatctggtttatcggacaacaaaagattctctctgtcggttttctctagcaatggttgggtagctgaacagagcaggatggtcgaattcaacactgaggaaagaaaactcaccacttcattgaataggttgatggcattggtcggcaaggactgtatttcatcaaagatgatcaccgaatccgccatgttatggaatttacgtaaatcagtgccatgcgatgacatcaccgtttcaaggaactgcaccatagtcgtcacaatgatgggactatcccaacgttcggccgccaacttgcgattatgctccaccgggccttcgttctcttcattctgtccattggcgcttcctcgttcgaattctcgcccttgagcgcttgaatagtgttcaagcagcaccgaactttcctcgtccaaattcaacatgtttttaaaagtcttcgaggtctgctcagtaatggacagatacggaatcacgtagatgatgcgtcgtttaccttggaatgcagcatgatggagcgcgtaatttagcgaagccagcgttttgccgcctcccgttggcacggcaagtctgtagataccagttggccttgatgctgcttcacgacacttccttgaaataacgcctcggatacggttgatttcagaatcctgattgaatgaacacatattgtggtcaaagacatcgatgagagactgccagtccacgacatgctcagaataagtaccccctttttcaaagcatgcggcatcaagtctatcagcatcgaccaatcttgaataaaggtatttgacgaataagccgagataaaaattcacgctgtctttcgacaacaaattgccattgctttttttgagttgattaatccgaaacaccaagccttctacatcaatggagctttggcgcaaccgctcatcagcatcaagatcaagctcgatttcatgagtcttgacctcttcataggcgtattttccattaatttccttcttctcagaaagatcttcaaagaagattttcatgccaacatcacctatgcaatcaggcaaatcgccatgatgagaggaaatgatcagctccagaatctctttcgccaatcgtgcagaagtcttatgccccgaaggcagagataaatcatcgactgcgaatgcgccctgccatgcatggacaacatcaccacgattcccttctccgttcagaagatatctttgaaatcgtcgctgcgctttaccaaaatcatgtaatacggcagccatagaggcaatatctgcatactgtggttcaaatccagcggcataatacgcagcatgatgcaagtgatcagccaatgtctgcatcttgccagacttgtccttgcgagccatcagcggcagtgaactattatccgaaatgcaagccacatcctttatttgggctacgctcataatcgtctccgtttcttcagcaggaggccacgggcgttttcttaaaaataaccgtacagccactctctaccgtcaatatgtaatttaccaacatcgtaaggtgaaataggcactccttccgcacaggactcgacacgaccgacactatctagtcccctcttctctccctaacccagccgcatattcgtcaagcacgtcgagaatgccacgatgctcatatgcaacgctgcgttgccttcccgtgcgctccactacaacaccacgttcgctcaaggtcttgatcgcacgctccgcttgcggtttcgacaatcccactgctttctgcaggtatctcgtgttgatgatcggctgcgcgatcagattcggcaacactcgccacacggcggcatcagaacgtacaccttgcaaaagtgaacgaccttcgtccaactgttcgcacaaatcgtcgataagcttcctgccacttgtcacggcgaatcggcatgcctgtgcgaattgtctggcaatcggtgcagcatcaccttcccggaagagagtcaacgcctcgaaatagctctccgtatcatgcaacaaaccagcggaaacaggaggcgtggtattgcaggacaaccttttattacgaagaatcacatgcaccaacgcacgcccgcaacgcccattgccatccgcaaacggatgaatggtctcgaattgcgcatgcgcaatcgcacattgcgccaccaccggcagatcgtcatgcttgatgaattcaagcagatccgtcttcgcatcggcaatcagctcgggctgcggaccgacatgtgccgccccgcgcggtgaatagctgtcggttccgacccacaccaggttcgtgcgataggcacccgcatattcctcccagccacgctgcgaggaaagcagagcttcatgcatggcgaggatgttgttttccgtcatgctattaccaagcttcagcgcagcctcctggcgcgcacattgccgactacaaccgcggcattgtcgcctgttccctcgtcaatcgtttccagagcaaggttcttcgctccgaccgttagattctctatctgcgaggacgacgatgcttcagcacgcagcaacactgcactcatcgggccaagcacgtgattgtcctcgccaagtttcgcagcagcataggagtcaaaggaagccaatgcacacgatgccttttcacagtctgcaagcagattggaggggaaaaacgtaattcagacccgcaagtttgatgggcacgttcgactcatattcgtcattgccacgcgaacggcgcgaccgcgaaacgggagcatcttccggaatatgccagatatgtcgctcttttccaaacaaagggatggcaagcgcctcgttggtatccatggttcccgttcctagttagctacatttatctgtttaagtgtagctaaatgacgatgtcggtcacggataaggttcaataagtccggaagcctcacttgcttttatggcgttgccgaatcccagccacaagcgataatgacatatacaggaacaaaggagcacaccatgcatctgggcatcacaggaaatatcgatttcgaagagggcgtttcctcacccggtgatttgctgttccttggattccatggctatggcaacgacgaatccgagatggttcgcatcatcaatgcgatttgcggcgatagcaatgccgacaacaccaccggaagcaccgttgctactttcacccactaccccaccacccgccgccccagctatctctcgttccgcgcgccacatgcacgcccgtacatcggtggtcactactggtatccggacggctgctcggtcagcgagcgccgccgcgcgtgcaccgagatcggcgatagcgttgtacagctgttggacgctccggcgttcgggcagtttcgtaaggtgctgattgggttttcgcagggtggttatctgtcgtatcgcatggttgcggagcatcctgatgtgtttgatgccgcgattttgctcagtccgtcgtttaagggcgaggctgccagcgagccggttgctggccatactcgtttcgcattgtgctatggtactgctgatcgtacgattcccgccgccaatcagcagtgtgcgcgggcgaagcttacggcgacgggtaactgcacggttttcgaatatcctggcatggcgcatgccgtatgcgatcaggaaatcatcgatttgcggaattggcttaaatactaggttttggcgtgcctatttggcatttcttaccaatcctatttgacactttctaccgtttctactttacattttctaccttgatggccgatggaatccaagcaatgattcgtggcacacacggccaggcggaagtatgtgcgaccgcgtatagcccgcgacggcagctcgccgacaaaaagaaaaagccggacggtggattttcggcagcccacccgcatgggggcacgcccgtcaaatccagccgtccggcaacgcgactgcttctcaagaatgtatgcttgactcacatggatggtactgaaaaccattcgcttaacgatctgtttccgcacgcttcggtcgcattgaacaacacgatcacgcacgcggacacaaatcaagtcttgcgcgattcgagccgcggtggacaataccacggcggctcgaaagccaaaggattactctagccgcagcttggaataatcgcaagctgattggatttcacggaattcgcgaaatccacgaaatccttggaaccagatcaggctttggcgacctcgacgttcagctcatcgccggccgtcacttcgaaagaggtggcgagcgtttcggaagagacgagctccttgaactgttcgaccttggccacgtcttcggcgggtacaacgagcttcagtgcgatgcggtcggagatttgcagatcggcggctttacgggcatcctgcacagcgcgaatcacgtcgcgggcatagccttctgcgatcagatcgtcgttcaactcggtgtcgaggatcacgaagccaccggtcggcagtgcagcacttacagagttggcggcctcttcggcgttcttctcctccacgctgttgatcagctcatattcgccttcctcaagcacgatctcaccgttcggagtctcacataccggagcgccttcggcattcacatgccatgcaccggacttggaagccttgatggcgaactgcacgtccttgcgaagacgcttgcctgccacgcgagcgttcacgcgcagctcgttgatgatcttcaagccttgggtttcggcatcttcaagcgtgcacagttcaacgttcttcacgttcagttcggatttgagaatctcgtcgtatgcggccacggcggcagtgttttccaccacaacggtcagcttatgcagtggctggcgcacgcggatctgcttcgtcttacgcatagacagggtgccggacacgacctcgcgcaccttctccatcgcgtcaaccagagccggatcgtcaacgagcacacggcccagttcgctcgcttcgccggtctgttcgtcggcaaggaacggccagtcggccagatgcacggattcgccaccggtcaggccacgccacaccgcttccgcttccatcggggcgagcggtgcgatcacgcgcatgaatgcttcaagcacggtgtacagcgtgttgaatgcgttcgcatcctcgttccagaagcgatcacgattgttgcggatgtaccagttggtgagcatgtcgatgaaatcggacacggcttcgcatgcgtcagagatcaggaagtcatccagcgagctttgcgtcttttcgatcagacggcgggtacgtgccagcaggtagcggtccatttccggcagtgcggcgacctcatcggcatgcagtgcacgagcatcgaaaccggcaccattattggcggcgttcgcatacagggtgaagaagtagtacgagctccacaccggcagcatgacctggcgaacggtgtcgcgaatgccatcggcggtcacgatcaggttgccgccgcgcagaatcggcgagctcatgaggaaccagcgcatggcgtcggaaccgaaatcgttgaacacgccgttcacatccgggtagttgcgcagatgcttcgacatcttctggccgtcggagccaagcacgatgccatggcagatcacgttcttgaacgccggcttgtcgaacagggcggtcgccatgatgtgctgcacgtagaaccagccacgggtctggccgatgtattccacaatgtaatcgcacgggaaatgctgttcgaacgtttccttgttttcgaacgggtaatggtactgggcgaagctcatggaaccggattcgaaccagcagtccatcacgtcgctgatgcggtgcatgtgactcttgccggtcggatcgtccgggttgacgcgcgtcagctcatcaatgtacgggcggtgcatgttgacattgccctcatggtcgcgcggataatcgccaaaatcagccttcagctcgtccaacgaaccgtacacgtcaacgcgtggatacttcggatcatcggaaacccacaccggaatcggcgaaccccagaaacggttgcgggaaatggaccagtcacgggcgttggccagccatttaccgaactggccgtccttcacattgcccggaatccagttgatctgctggttcagttcgagcagacggtccttgatcttggtgacagacacgaaccaggagctcaccggcttgtagatcagcggagtggcgcaacgccagcagtgcgggtaggagtgtacgtagctcttctcctggaaaaggatcgcgcgctgatcttccggaatacgctccagaggaccgtcgccggcacgcaggttacgcaggatcggcttgttcgcatcgaacacgtacatgccctcgtagtccgggcacagcgcggtgaacttgcagcccgcgtcgagcacgtcaacgctcttgatgcccttggcgttgagcgtgttcatatcgtcctcgccgtacggagcctggtgcacgagaccggtaccttcaacggtatcgacatagtcggcggtgaagatctgatagccttccggacccggaaccttgccctcgacggcgttctcgtcgcctgcgaagtacgggaacaccgggtagtagcgccagccttccatctcggcacccttgagttcgcgcacgatctcatagttgtcgccgagttccttggcgtaggagccgagcagtggcttgcccaggtagaacttcttgcccgcgaacttgccttcggtcggacgcacttccacatagtcgatgtctgcgccgaccacgatggcgaagttggtgggaacggtccacggcgtggtggtccagaacaccgcataggcgtcttcctcgtcgcgcagcttcacggccacggacacggtggtgtcctgacgatcctgatacacgtcggcgtccatgcgcagctcgtgcgcggaaagcggcgtctgatccttcggacagtacggcagcacgcggtagccctgatatgcgaggcccttgtcgtacagctgcttgaacgcccacatcacggattccatgtatggaatgttcagcgtcttgtagccatgctcgaaatcgacccaacgtgcctgacggtgcacgtagtccttccactcgttggtgtacttgagcacggaggcacggcaggcgtcgttgaacttgtcgatacccatttccttgacctgatcgaccgaatcgatgcccagttccttctgggcttcaagctcggccggcagaccgtgcgtatcccaaccgaacacacgattgaccttgcggcccttcatggtctggtaacgcggaatcacatccttggcgtaaccggtcagcaggtggccgtaatgcggcaggccgttggcgaacggcggaccgtcgaagaacacgaattcgttctggctgtgatcgccggaaggacggcgttcaatggacttctggaaagtgtcgtccttctcccaataatcaaggacggattcttccagcttcgggaaactggggttcggcgctacattggcgctctgctcacccgcagctgccttcggatacacgttgttttcgctcaccgtatctcctcgtaggttcttgctatctatctcctacgaggacgatggccgtaacgtctgctggacgccgccaccgcggtaccacctcgtttgccgcactttcaaatatacgtgcgaccgcttgtatgttcggctattcgggccttcccgccgggtctaataagtcgctcacgcgaccgttcttccggaagctccccgctgataacggatcatcgctcgcatttcggttgtcactatagcatgcagcgcgaactattttcgcttgttttgcatgattatggacgatttcacaataggtttcatgacgattcacaatagctcttatgtaggattacatacaacagaaatgccgatactgacagcccatcagtatcggcattgtaatcgtattttcaatatgtatttttagaacatactatgttcgatcattcggagatttcaccggaagcaagcttggcttcgagctcttcgacaatctcgtcgtgcatcttctcggtgatcttcaccttgaagaggaacacgagcaggctcagcacgatgatgcccagcggcacgtagaatgcgcagaccttgaacatgccgatgttcgcggcggtcatatccgcggcggttgcgtcaccgatcatgcctgcggctacggcgatgaagccgacgataccgttggagcatgcgcctgcgatcttgtcgagcatcgggcggacggacagggtgacggcctcgttacgcttgccgttcttgagctgaccatattcgatggagtcggtcagcgacaggatggcggtcatctgaatgaaagtctgcggcaggtagaagaagaccagaccgacgatgaccattgccagattgctggagccgacggcgaacagcaggtagccgacgatcatgagcaccatgccacccaagtacaggtagcgacgcggaatgcgcttgttcaggatcgggtacagcggagccataaccaagccggtgatgaccgggatgacgcccacgatggagtatgcggcggtgttgtcgaggatgtacttgaacaggtacatgagcacgccggtggtggccacgttggcgatggcgtacagcaggtagctcaaggcaacccacagcagctgatcgttctgggccagagccttgaaggcctgcagcgggccgccgttgtcttcggccttggcacgcagcgtggtggtgctttccttggtgccgaacgccacggagcacacggtgaggatgccgaggatggccacgatgatggcgaagcaggtccagccggactggctttcgacgtacttgccggtgaacacccagctgaagtaggtgacgatcgggatgaccacgatggtcagaccgttgtagccgatggagccgccgaaggagccgagtgcggtgtaggtggagcgctcgtgggagtcggagctcaatgccgggatcataccccagtaggaaatgtcacgcagcgagtagaacacgtcgagcacaatgaaggtgatgatgaacagcacgatgaacagggtagtattcacgttcaccagaccgaacagaccagtgtagacgagcaccagcaggatggcggaaacggtaccaccgatgagctgccacggcttgaagcgaccccacttggtgttggtgttgtcgatgatgttgcccagcagcgggtcgatgaagatttctgcgatacgaatcaccacgaccaggccggtgatgatgccaatcagcttggtggcgacgctcttatcgacgccagagaacagcgagctcgtcacgtagacgatgaaataggtgctcagtgcgttgtagaacgcggactggccgacgttaccgaacgagtacgccacgcgagacaagaggttcccgcctttggaaccgttgttgccatttcccatctttgcttctccttagaagtcagatacaggtccttccttgacctaactatcagtatatccccttacctaaagttagtaaaatttatcactgaacatatcgcctatcggcgtgtcatattttgtgagcttctgttcgaaagatagccaaaaacgttattttttcgccatttacacaacaaaataggcaaactgtcgcattatcttgtggcagcttttaccaaaatcgatatttacgatatgcaaaagcttccacgtcgaaacgaaaccaagccaatctggaaatagcccgattactatacagaagtaaagaaataaccgctattttgccggcacaaaactatcgcgcaccaccagcgacgtcgacaggtacacatgctgacgaatcgtgcgtttgccggaaatggcatcacccaacatcagcgtcgccacgcgcgcaagctcgttctgatcgatggagaatgtgctcaacggcggcgaggtcaactgcgaaatcgtttgattgttaatgctgatcacgctgatatcgcgcggcaccagcacgccaaccgcattgaacgcctgcagcacgccaaccgcaatcacatcggcagctacgatcacggcatcaggcagcacgccattatggtcgcgcacgaattgctcccccaacgcacggccgttgctcacggtgaacaagccgtcggaatacaccaatccgtcggattgaataccgaaacgccttgcctcacgacggaaatatgtggcgcgattctcctcatcgacctcataaaagttcatcaggcagcccttgcctccgatgaatccaacgcgcttcatgcccttggcagcacaggccgcgaccgcatcatgcatggtctgctgcaaatcaggctgcacggaatcgaacagattcggcgccggattcacgtcaatgaacacgccatacggcatggccctatgcagccgctccaagtcttcctcgctgatctggtcggcgccgatcgccatgaacccgtcgaatttggaactgcgagcgatcatatcgtcgagattgtggaacaccgtcatttccatgcgttgctgttccgcattgcgttcgagcgctgaacgcaaatcggtgaaataggagtcccgcaacgcctcgtcggacttttcattgtcaagcaatgcaacctcatgagggatgacgatgcgcttggtctgcacgctatagccgaggtcctcgctcgcctgaatgatcttgcgacgagtctcttcacgcaccgatagggtgggatcaccgttcagaagtcgagacaccgtagcctgagaaaacccggtacgttgcgcaatctctttaatcgtcgccatgtctcgctctccaatttagtaaatcgtttacccatgaaaggataacctattattgacataacgacaagccaagcgagatttatgcaacgattacgcaagccaattataatcgcagctcatgcagcagtctcatgaacgtatgacggaaccgccttcacggaaggcgggctggccgcagccgaataccatgcatggcaaagacaataagaaatcccttgcttcaaaatcgcaatttcaaagcaagggattttccagaggatccgtgccgttcaaagccaccggccataagggcggtatcagccgacagggatcgaagcgcggctagtgtagaacgctagcgtgtgctcgcatcgctccaattcaggagactattagattattcgagttctacggcacctgtgtagagctgatagtactcgcccttctgcgcgatgagctcgtcatgcgagccgcgttcgatgatgcggccatggtcgagcaccatgatcacgtcggagttgcgcaccgtggagaggcggtgggcgatcacgaacacggtacgacccttcatgaggttgtccatgccggcctgcaccacctcttcggtacgggtgtcgatggacgaggtggcctcgtcgaggatcatggccggcggatcggccacggcagcacgtgcgatggaaatcaactggcgctggccctgggacaggccggagccgtcgccttcgagcacggtctggtagccgttgggcagcatgcggatgaagccgtcggcgttcgtgagcttcgcggcggcgatgcattcctcatcggtggcgtcgaggcgaccgtagcggatgttgtccatcaccgtaccggtgaacaggttcacgtcctgcagcaccacacccagcgaacgacgcagatccggcttgcggatgcccttgacggaaatgccgtcatacaggatcatgccgtcttgaatgtcgtagaaacggttgatcagattggtgacggtggttttgccagcaccggttgcgcccaccaatgcgatcttctgtccgggcttggcgaaccaggtgatgtcgtgcagcaccggtttgtcggggttatagccgaagttcacgtcagtgaagcgcacatcgccctgcaggagggtgaggcgaccgtccggtgaggtaatggcggtttcacgggctttcatggccacttcggcggcacgcgggctcaaggattgcgcggccttgagcgaacgggtgccgtcatcgccttcctcgcgcttccacgcccagtgaccggtttcatggtcaacttcggtcatggtgcgtccatcttcgccgagttccacgttcaccaaggtcacggaaccgccgtcgtcctccggctgctcgtccataagcgcgaagatgcgggatgcgcctgcaagcgccatcatcaccatgttgaactgcatggacacctggccaagcgggttcacgaaagagcgggacagcgtcaacagcgagatcagcgtacccagggtgagcgggccagcaccggacaatccgaagttgccaagtccggaaatcgctgcggatccgccgaaaatagccagcagaatgtacagcaggtagcccatgttgcctacgatcggcatggtcacattgccccacgtgttcgcttcggcggaagcttcgaagagttcttcgttcttcttgtcgaaagtggtttgggtggcgtcttcgtggttgaagaccttgatgaccttctggccgttgaccgcttcttccacgaatgcgttcacatcgccgatggcgatctgctgcttgacgaagtagcgtccggagcgggaaacgaccttgcgtaccaccacaaacaggatcacggtgaaggcgagcacgaaaatggtgacgggcaccgacagccacagcatggagacgagcgccgcgagcgcagacaccgcagacgagaacatttgcgggaacgactggctgatggcctggcgcaatgtgtcggtgtcgttggtgtaacggctcatgatgtcgccgtgttcgttggtgtcgaagtagcggatgggcagggtctgctgatgggcgaacatgtcgtcgcgaatcttcttcaacgtgccctgttccacggtgacgatgacccactgccacagccagctgcagaaaataccggccgcatacaggcatgccataagcgtcaacgcacgcagcaacggcatccaatcaggattggtggcaccgaccatcggcagaatgtacgtgtcgatcaacgactgcaggaacagcgacgatccggcctgcgccgcggcaccgacgagaatgcacaccaccacgagcgccacacgccacttgtattggaagacgtagccgaagatacgcttggtggtgccgggtgcggctttctgcaccggcggtttgccatgcgattgctgcatgccggccgcgttgttgttgtctttggatttcaatgcggaagtttgttcagtcatctgttgcctcctttcactgcagttcctcaggctgggcctgattcttggtttgcgattcgtagatggagcgatattcgtcgcagttttcgagcagttgttcatgcgtgccggccgccatgatgcggccgtggtccatgacgagaatcatgtcggattcctgcacggaggccacacgctgggcgatgatgatcttcgtggtgtcgggaatctcatgatggaatgcggcgcgaatcagctgatcggttttggtgtcgaccgcggacgtggaatcgtcgagaataaggatcttcggctttttcagcagcgcacgcgcaatgcacaaacgctggcgctgaccgccggaaacgttggtaccgccctgttcgatgtacgtatcgtacttgtcggggaattcctgaatgaagccgtcggcctgcgcaagctggcatgcgtgacgaatctcttcatcagtggcgttcggattgccccaacgcaggttttcggcaatggttccggagaacagcacgttcttctgcaataccatggcgacctgatcgcgcaatacttccaaatcgtaatcgcgcacatccacgccgccgaccttcagcgagccttcggtcacgtcatacaaacgtggcacaagctgcaccaaactggactttgcggaaccggtgccgccgacgatgccgacggtcataccggaacggatcttcaaatcaatatcgtcaagcaccggcttttcggaagtggcggaataacggaaggtgacatggttgaaatcaatctcaccattcttcacttccataaccggattttccggattcgtaaccgtgctttcctcgttcagcacctggcagatgcgttcggcggaggcctgcgaaataatgcacatcacgaaaatcatggacagcatcatcatggccatgagaatctgcatggcgtaggtgaccagtgcggtcagatcgccggtggtcaagcccaaggccgcattgttgccggatgccacgatctgctgggcgcccatccatgcgataagcagcatggacacgtacacgcacagcatcatgagtggattgttgaagctcataatgcgttcggccttggtgaagtccttgaagatgcgctcggaaatgcggttgaacttttcggtttcgtggttttcgcgattgtaggacttgaccacgcggatgccctgcaggttctcgtcgaccacgttgttgagcttgtcgtacgtgtggaacacgcgctcgaacaccggatgcaccagtactgccagaccgcacaggccgatggcgagcaccggaatgcaggcgaggaacaccagcgaaatggatgggctgatgcggaaggagaagatccacgccacaatcaccatgatcggagcgcgcacacccatgcggatgatcattgaatatgcgttctgcaggttggtcacatcagtggtcagtcgcgtgatgatcgaaccggtggagaaacggtcgatattggtgaagctgtagccctgcaccttctcaaactggtcgtgacgcaggtttttggcgaatcctgcgcccgcaatggccgagaactttccggccaaaaagccggatgtcagcgaaaccgccgaacaaatcagcagaatcaagccgaatttcaaaatcgccggcatgctgccaccgctgatgccctcatcaatcagcgatgccatgacagtcggaataaggatttccagcacgctttccacggctacgaataccggggagagcaggctggcttttttgtattcgcgcagggatttgcccagtgtgcgaatgacgtgttgctttggttttgacgttgtggacgtcgttgcgtttgccgctgtcactccttgtcctttctttttcgtacttacttgcttgcgtgtgttacctgaggttgtttgcgatcgccatttcctgcgacattcgcagtatgcgcgaaacgtattcatcatgagaatcgcgattatgcggattccgtacatcgcatgattcttgcgattcttgcgaaacctgcggcttttgcgaaacctgcgattcgccaaaatcctgttcctgtatttccaagcttgaatatcggctttcgtctccgatcaaacctgttttcaccagattcgtctgcatgacgtcaagcatgtgcatgaattggcggatctggtcgtcatcaagaccttccaacaggattcgttccatgtttttcgcattgtcgtgcagcacttcggcaatatgcctcgatttgtccgtcaatacgatctttttcagacgtgcgtcacgcttcaccgactcgcgggcgatcagccccttctgctccatcagtcccaacactcggcatgatgtggatcgggtcacgccgaaacgttgctcgatgtcttgagggaagatctcctcgttatcatgtcttgccaagtacacgatgatgtcaacgttgccgttgctgacgtcttccgcctcttcgggacgggtgacgcgcaaataccggttgaccacgttgtgcagcgagcgaatggccacgctgggaggcttggtcaggccactttcccagacttcggcaagtcgtgaacctgacggttccttgtattgttcattcgtcacttctgtcacaccacacatgctaaaccgttgcatatacaactgttgtacatgcaacgattagcgtgtcgcgcatctcatcgtccgcgacaaaaaaggccgaggaatcagatccgcatcggttcagcgttaacggatcgaatccctcggccttaagccttgaatcctacgaaactacttggtgagttcagcgtacttctcaagcatgtattcgaagatctgcttgccatcggcgcccatcagcaccgacatgctgttgatcggcatggaatcgaggaacaggcgggtcatgtcgttgtcgggcaccaccggcatgcggccggcttcgccctcggcacgcaggatttcaagcaccttggaaccgagcggatccttacgccattccatgaagttggaccattcggtgagcggctgggccttgccgtcgccgtcgagctccaccaccgcggaaccggcaatgtcacggctggacgtgccgacctcgatggtgtattcgccgctctccacgtgccagtcattgaacctctcagaccagtaggcaaaggcgcgatcgtcgagctcgaaggagacttctgcggattcgccagccttgaggaataccttcttgaagcccttaagctcgtgtttcgggcgaactacgtcggccttgccaggagccacgtacacctgcacggtttcggcggcgtcaacgttcgaggtgttcttgaccactgcgctgacggatgcggtacaggcaccggtcttgacagccttcacgtcgctcacttcgaacgtggcgtagctcaggccgaatccgaacgggtagtcgacggccttgttgtaggtgtcgtaatagcggtagcccacgaacacgccttcgccgtagtcgacatgcccctcttcgcccggccagttgatggtgctcggatcgtcgttgatgtcgaacggaatggtctgcgcgagcttgccggacgggctcaccttgccgaacagcacgtcagcgagcgccggaccgccggactggccgagcagccaggattcgaggatgcccttggcgttcttggcccacggtgccacggtgacgacggagccgttggagagtacgaccacaacgttcttgttttcggctgcgacggcttcgagcagtgcgatctgcttggccggcatgtcgagggtctcacggtcgaagccttcggattcggctgcttcggggagccccaggaacatgagcaccacgtcggcgcccttggcagcgtcgacggcttcggcttcgagtgccggatcggccggttcgaggtcgagggtgaagcctggggcgaacttggcgtccacgccgcgttcggtgagggtgtcgaggaagctggtcatcttggttggggtgatgtgcgaggagccgccgccctggtagcgcggagtgcgtgcgaattcgccgatgaccgtgaccttggcatcgccggcgatcggaaggatggcatcatcgttcttgagcagcaccatggattcgatggccgcctgatgtgcgacttcgtcgtgagcttcgatgtcgaaacgatagttttcgatgctcatggctgcgcgcgtcttgttgaccaggtcgatcatgccttgtgccatgcggtcgagctgtgccggctggatgcgaccgtcgcgtgccgcatacacgatttggtcgtcggtgtagcttggcggcatttcgaggttgaggcccgcgttgagggatgcgacgcgatcatggtcggcgccccagtcgctcatgacgatgccttggaaaccccattcgtcgcgcagcacgtcggtgagcagccagtggtcctgggcggcatgcacgccgttgatgcagttgtatgcgcacatgatggtccacggctgggcttccttgacgatgtgctcgaacgccgggaagtagatttcgcgcagcgcacgctgggagatgttggcgctgatgcgcagacgatcggtttcctgattgttggcggcgaaatgcttgagcgaagtgcccacgcccttggattgcacgccggcgacgatgccgatggcttcatgacccgccaggtacgggtcttcggaccagtattcgaagcaacggccgccaagcgggttgcgcttgatgttcacgcccgggccgaggattacggcgaccttctcctgaatgcactcttcggccatggcttcgccaacctggtggatgagttccggattccaggagctggacagaccagccgccggcgggaagcaggtggcaggcacgcagttgttcaaatcgacttcgccggtggtggccgagttggacttgcgcaggccgtgggggccatcggtgatcatatagccgggaatgcccttggcttcaacaccctgcagatgccaagcgtcgccgccggaagtcagggatgccttctcttcaagcgtcagatcattgatggaaggataggttttttcgctcatacgttcctctttcgcatcgttttcttgagttcgtatcggttaaccgatctgcatgagacctcaaccccgaaatctctactaaccggttggtaggtactttatcaaaaccaacaccgcaacacgccaatcttctttgaaaaatcaattaaccgaccgtaaagtaactgcagtatttacaacttgagagaaatgacgattcataagcattgcagcgcacatgaatcgccatcaatgaagggcaagagagggaatcatcatggccaacgaagaagtcgaccgaagggcggagattctcaacgcggccgtcgaactgtttgggacgctcggctattacggcacttccctgcagaaaatcgccgatcgcgtaggactcaccaaggctggcgtactgcattatgtcggcagtaaggaaggactgctcacagccgcgctggacgaagtctacgattccgaaacggaagacattcttaccgacatggtacgtgagccacgaccgttgatcgccgacatgtggcgcagaatcgtggcggtgaacgcacgcagaccgcttcaggtgcacatgttttccacgttgagtgccgaagcgatcgacccgaaccaccctgcacacgagtacttcgccaatcgtgagctgcataatgccgataccgcgctcaatatccgttggcgtgtgcccgaaggcgttaatacgcgtcggctgcttaatgcgggattcgccatgatggatggcgtgcagctgcgttggctgcgcacgcccggtcaggacctgaacgccatgtgggcggaatgcgaagactccctgttccccctgcccatgtgggagggctaccgctaagcctctgccccggcactgcattactgtatggatgcagacgtagaaggaggcatgtatgcggattttgctggcaccggactcgttcaaggaggccgcttcggctgaagcaatcgcacaggcgatggctcgtggcattaagcgcggcgacccgcaggccgaatgccggcttttgccgctttccgacggtggcgaaggattgacgcacgccttggttcatgccaccggcggcacgttgcatgatgttgagacggttgatgcggtcggtcgcccgattattgcgcagttcgggtttcttggcaataagcacacttcccgtaccgccgtggtcgagttggcttcggcaagcggacttgagcaggtctcccctgccgaccgtgatccaatggctgcatccacgtttggcacaggcttgctgattcgagctgcgatcgacgccggcgcggatcgcattgtgctcggcttgggaggtagcgccaccacggatggcggtaccggattggctcacgcatttggatttcgttttctcgatgcgcatgattccgacattccgcttggtggcggcgctcttgttgatttggcaaggattgacgattcaagagtttccgattccatcaaaaacgttccgattgttctcgcttgcgacgtcaccaatcctttgaccggcccggaaggtgccgcccatgtgtttgccccgcaaaaaggcgcgaccgcaacacaggtcgagcttctcgatcaggggcttgcgaatctcgcgcgcgcgatcatgcaatataacggccgcgatatcgagcacactccgggagcgggcgctgcgggaggtaccggaggtggcatgcttggcctgttcaacgcaacagtgaagccgggaatcgaactcgtgcttaatcttgcacatggccgtgaagcgtgcgcttgggctgacgtcgtcatcaccggagaaggttctatcgacagtcaaacgccatacggcaaagtgccaagcggcattgcaaaattggcgcaatcgcaaggaaaaccaaccattgccatcggcggaacggtaacccgtgacccacacaccgtcgaagcgctgaacgaaaccggcattatcgcaacattcggcattgcgcccgggccagcagatcttacaacgttgatcgccaacacggaacgcaatgtcgaaatcacctgtgccgcaatcgccagcacattgcgcatcaccgcagctacttcaccctgcgaatcagcatgatgaacaccgcacccagcagcaccgcgaccacagcgatcgggaacagcgccgcataactgccagtggcaagcacaatcgcaccgacaaccacaggcgcaagcacctgaccaacggtgttggcaagattcagaatgcccagatccttaccagcttcttcctgacttggcaacacatcgacgttcaacgcctgatcgacggcaatgtaaatgccataaccagcaccgccgatgcctgcaaacagcatcatgcccaaagcattcggcatgaaacacggaatggccacaccaatcgcgataatcaccgaaccgatcgccacgatgaccttgcggcgctgcagacggtccgacagcggacccgacaccatggacgtgacgatcagcacaaccatggaaatcaccgacatggtggaaatcgtcgccgcggaatcctttacgctcaacccgcagtatttctgcagaatatacagctgatagccggaaatcatgttccaacccaagataagcagcaatctgcccatcaatgccaagtaaaaatctcggcaattcttggtgggaggaatgaacgaacgcagcaactgcttgacgtcgagctttgcggtggcatccgaagactcgacggaagccacagaagcagccgaggagcgttcgcgcggccagatcagcacggtcacgataccggtgactgcgaacagtgccgcaccgatcgcaaatccggtgcccatgttttcaatgaatttcgatccgaggaacgttccggcggatgatccgacgatctgcgcaccaccatagaatgcggagaacgtaccacgcacgttttccggaatgcggtcggacagcactgccacagccggagcgatcatcatgttgacgccgacctgcacaatgcaccatccggctacaatacccaccaactgcgcactggagaaggcgagcacatagccggctgccgtaatcagaccacctgccacaatccatggcgtgcgcttgccgaaacgcgagcgcgtgatgtcgcttaacgcaccgaaaatcacgttggagaacagtgcgaatacgcagcctacggaattcatggtgccgagaatcacttcgggcatgcctatgttcagttcggtgaatcgttgcggcagcagcacggccgatccggaagtgcctgcgaccatccaaatcagcgagaagagcacgaagccgacgccgaatcgccatttttcggtggatgtcagtttgcggccgctgtcaggtgcgatatcacccaatactgcggtgcttggctcgcgtgatgcgtttgctgtcatgattccccctttggaagcatgttcttttttgaaatattgaaatgatttgaaatatacgatgaagaaagcttttttcatttttggtatgatcgcagtcctgccgacgccgacttttatttggcttcagcttcggcaggactttcgttcatatgatttcacacgattccgtacgattacagcgccatctgcagatgatgcgttcccgcaacaagatcgacgcgctcatggtcgacgatatccacgaatgccgtggttccggcaggtaccgcaaccgtcagatcaagcacattgtcgttgacttcccattgcacttccgccttgccatatggggtgatgtgagaggtttcggcatgggtgagatctcccccgatcaccggagcgatacggaaccgcttccagccgggttcaacggcttcaaggccgccgatatgcgcatgcatccattccgccaccgatccgagcgcgtaatggttgaacgaggtcatgccgccggggttcagcgaaccatcggcccgcatggaatcccaacgttcccacgtggtggtggcccccataaccacttggtaaagccagcttgggcattcggtggaggtaagcagcgcgtaggcctcgtcgttatggccggtcatggtcaacgccggaagcacgaatggcgtgccggcgaatccggtgcttaccttgccgccggattcgcgcaccaggcaggcgagtcgattgccggccttcacgcggcgcaccggttcgccgtcaagcagtccgaaggcgatggcgagcgcgtaggcgcactgggtgtcggatgtcatggtgccgtcaaggttggtgaaacgctgcaggaatccatcaatcacacggtcacgcagggcggcgaatcgagtttcatcatcggttttgccgagaatatgcgcgatgtgcgtgccttgcatgcagctgcgtgcgtagaacgcggtggcgaccagttccttttcggtcatggcctgcgtaggatcttccggaggcgcggtcggatcaagccaatcgccaagctgcccgagcggatagtccggcttgcgatcccatacgccatcgggcgaaaggtaccctgccacttcatcgatccaatcacggatcagatcgtaggaatcggcgagcacctgcacgtccccgctttccatgtacagtgtccacggcacttccaccgccgaatcgccccacgtggagatggcttgtggatgcgcccatacgcccaacggcacgaacggcacgtagaacggcacagtgccccacttgacctggtcggcacgcacgtctttcagccagcttttcaggaacccgtatacgtcatacaaataagccgcggtaggcacgaacaggcagatgtctcccgtccaacccatgcgttcgtcgcgttgcgggcagtcggttggaatggacacgaagttggaacgcatcgaccatacggcgttctcgtgcaaacggttgagcagcggattcgatgtggtcagttcgccggtgcgttccatcacggaatggtagacgcggcaatccatgtcggctgcggtcagttctcctgcgaaaccttcgatctgtgcatagcggaagccgtgcatcgcgaatcgtggctcccaccaagcgtcggaaccgttggaagtgtacacatcgcactgctggcctctgcgcaaggttcgcgtggcgatggatccgtccggttccaacacttccacatgacgtaacgtcacgctttgttctgcttcaagatcgcgcatgtgcaggcggatgcgctgcgaacagttctgtccgaagtcaaccagccatatgccacgaccatcttccgtgttgccgatgcgttcgatgctgaccggctcatgcgattcatgcgcgcgcaccggcgatgtttcaggattttcaatacgtgccgggtcatacatgacttccgcgaccggctgccaggagctgtcgtcgaatcctggtttcgaccatcccggctgttccagtcgagcgtcatatcgttcgccttcgcacagatccgagcagacgatcggtccgagcgtcgccttccattggcggtcccatgcgttggaatatatgttctgcatactgccgtcggcatattcgacctcaagttgcgcgaatacggcaatacgatcgccatagaagttggagtaaccgccatcgaagccgaggcgtccgcggtaccatccgtcaccgagccagaatcccaatgcgttggcaccggactgcagttcgtcggtcacatcgtaggtgaagcattccacgcgctggttgtagttgctccagcctggtacgagcgcgtcattgccgactttgacgccgttgatttcggcttccacaagaccgagtgcgcttagatataggcgtgcgcgtttgggttgttccttcagttcgacttcggtgcgcactaatggcaggtgacgatggtcagtttcggattcgctccacgatggtccgacgaaatcggcgacatgctcatgttcttccaatagtccgacttcgaaatgcagggttgcgctcggtttgcccaatggctggtgacttgccgaaacggcctgcatggtggcgaacacttcttcgcgtgaggcgagcggcgcgaactgccatggaataagcacggaagtgtcagtgggcaggtaggtgcgttcttccacaggttgcccgccgggaacacgtcgtgtcactttgagcaggatctgcgcgtcgattggcagcatgccggagcacacccatgtcatgcgtggggctgcggtggcgatgccgagcgcatctcccgggtagtgttccacggtgaagctgatgatgtcaagatccgaagccagcgtactgggcacaatctgcggatcagtaatggccatgatgacccctttgtctacaaaaataatagatcacttgtttgtgatggtgggaagccaaagtccgagccatgccgcaaggagagagaaacgaacggcgacgatggctgggactttggctggcaatcgcaaggtattgcataactgacttgcgattggagatattgagttgttatgtgattgctgttgctaatcaggctgcgatcttgcgtgcctgacgttcttcgtcggtgccgtacttcttctgagcacggatcatgatggtaccggcgatgccttcgatgattacgatgccgaagaagcaccacatagtggtctgaatggtttcaggaagcaccagagccggggtgatgagcgcgaacaggccacagcacagacgggagaagccgttgatgaagccctggatggaggcgcgaatctcgatcgggaaggattcctgggtccacaccttgtacagtgcttcgcctgccagcggggatccgaggttcatgaaggctgtcgcgccgacgatgacccataggttcgcaccgcccatggccatggcggccatggcgatcagcgagatcacgatgcctgcgaagaacgccttgttacgatatttgccgcctgcgatggacgcgaacacgatgttgagcacgagcgtcacgaagttgaggatgatgcccaagccggtggccagggactgggcggctccggccttggagaacatgtaggtctggaactggccccacgtgttggccagcaggttccagccgacgtagaagatcacgatggcaaggaagtaggtgagcagcaccttcttgtcggcgccgaacagcaccttggtcacggaaaccttgccgttgcctacaacagccggacgtgcggcgtcacgaacgtcggcagcttcatggaagcggcggaaggtcggagaaagcagtcgccacagccatgcgatcacagcgaatactgcgaggatggcgaacaccacacgaccaccggtggcaccctgcatggcggaaaccaggaacgcgcaaatgaaggagatgaacacacccacctgccagaacacctgggtggtggagacgagctgtgcggcggtggcctcgtctggagcatcatgggagacgatggtcatggaaaccggcagatccgcgccggaagccaaacctgcaatgatcaggccgatcagtagtacggtgaagttcggggcgaacacgcagatggcggcaccgatggcgtagaacaggttgatccagttgaaaaacagcacgcggccgatcttgtcggccaagcggcctccgaacagcgagccgaaggcgatggcgaaggtcagaataccggaaagcaggccgacctgcgtggtatcgagtccaaggccttcctgccagaccacaatggttgccgacagaccgacgatgatgccggatcccagcatcgatccgatgcctgcggcgaaggcgagcggcatgtattcgcccaatcctttgcccttcttggttgaagtattcattgctctttccttactttttcatacttgcatgcgttttttcacacaagtatgtccttcttttttcaaatggttttcactgcattttcaaattgccgaggcatctccttcgatctgtccagcattcagaaaacactgcgattccattgttttatacgccagaacatcctgccgtcctcagcagcacctccagtgatgttgtagttgaaatactacattcgtttttgaaaatttcaaaatcgtcgcgcgtttttcaatatacaatttcaaaagagagcgcgtagactattgatacatcaaggaataaccggtttatgtacgaacaggagcaatctcatgccagcatcaaaacgtgtgggcgtttccgacatcgccaaacatgccggcgtctccatcggcaccgtatccaactatctcaactaccccgaacgcgtatcggacaccttaaaagagaaaatcggcgcaagcatcaaagaactgggctacaccccccgcagaaacacgcttctcccccagcgagagaacgccggaccgcgcctcatcggctatatcatgaccgatatcgaacattccctgttcaccttcatccatgaaggagcgcaggaggtctgcgaagaaaacgacctgcagcttatcgccttgaacgcatcatccgacgcgcaacggcaaaacgaactggtgaaaacactcatcgacatgaacgtggccggaattctgctcagcaccatatccgactcccccgaagacgtggccgcggcacgagcggccaacattcccatcatcctgctcgaccataccaatccccgtcacgccgatcaggtgtgctgcgtgcttgaaaacaatatggcggccgggcagatcgcagccgatgaactcattcgcatcggatgcagccgcatcgcgttcgccgcacactcattcgactatgaatccgtacaagatcggcagatgggcgtcgaaaaaaccattgcgcgcacgcatggaagcacgcaattggaactcatcaattccaaaggtctgatgtttgaagacggctaccagctcggcctggacatcatcgacacaatgaagcgtagcggcctggacgccattccagacggcatcatcaccgtctcggacgcgcttgccgccggcgtgctgtcggcattccatgaccataacggcccacgggttccagaagatgtttgcgtcatcggcatggagggggcacggttggagaccaaatgccccatgtcgctgaccgtagtgaacgcgcccgctatcgacatggggcgcaaggccatggcgcagatgctcgactacatcgacaatcccgccgcacacgtgcacagcaccacgcttatcgagccgactctaatccgacgcgaatccacacgcgcataatcgcatgcggaacactgttagcacagcccaactcgacgcaatacaacggcaaggtgggtctccttacctggcgaaacccacccttactactattctgcagcgtttgaaaatttcaaaccatcagactgcggcacgggacttgtcttgcaagtcaccgaataccggtgtggccgaaccaagccagtcgcgctgttcctcattgcccatggcattacctcctaccgccattcatcgtcgaagcggcatatcattcaggctccgcatcctcacggagcaacctcacgggatgatagactttgccccgagggcaaggtcaacacgaacagtgaagcccacgacaaggagacaatacgtggccggcgatgatgacgagctgctgacgattggcgaagtggccaaattggacggcatcaccgccaaggcgttgcgctattacgatgcgcataacatcttgaaaccagccgcagtagatccggctaccgactaccgactaccgatactacaccccgatcaaatgcttgacgtcgatgtgatgcgtatctgcatcgccgccggcgtgccattggattcgttggagaaattccgtttcgaagacggttcgcttgattggcgagcgttacttgccgcagcgcagtcgcaggtggatgagcgcattcagcaattacgacgattgcagacgtcaatcaccgattattccggggaattggtacgcaaggccttctcccccgaagacgggttggtgcgtgccgatttgctgccgacttggctggttgcacaaccttgcctctacggtaatgtttgcgatataaaacgatatttacgcataatgacgtcgttgcgtaccttgattcgcgatgcgcaggcaccgcatttgctgcgcagaggcatactgttggatttggtggaatgcaaggcgttcgcttttcaacagttcgcgccaacgcagcgcatgcttgatattttccattccggcgatcgttcgcgagtaacctacgattaccactttcccactggaaccgttgttatcaatcctcccggaggtcctgcggaaagtcgcgtaatcgagcgtgaatcgttggcgcaatgctttgaggatggcatggcgttggctgaatcgctcgacgctgaggattggccgcatgtcaccatgactgagatttggggcagtcatgccccaaatggttcggcttgcaggctactcctgagcacgcttcaccgagaagcggaacatgagcaacgccagaatctcaccgcatacggccatgccgaagaacacccacatgctggtggagaagccagccacataagcgtcagcctgctgcatgccggcattcacgttggcggccgagaattcggaaatcaacgtggatgccacagccgtgccgatggcgcctgcgagctgctgcatggtattcatcaccgcggaaccgtcggcgttcatggaagacggcaactggttcaacgcatgcgtctgatcgggcaccagcacgaatccggaagcggccatgaacagcgcgtatgccacggcaatggctccttcgtgcgagccgccgagcatcatcgccacatccatcaccgccacgccaacaaaaccgcaggcgatgaacttcggcgggaaatgctctttcaacgcgccgccgatcagtggagccgacaccgcgccaatcacagcgcccggcagcaaaatcaaagcggccgtcatcgacgtatgccccaatcctcgctgcagcagaatcggcagcaagaagttcacaccaagcacaccgccggaagacatgagcagaatcaccatgccgagcgtgaatcccgaatatgcaaacgtacgcacttccaccaacggatgagccatacgcaactgcaatacggcgaacaccgccaacaccacaatggcaccgataagcacactccagaatcgccaatcgccattccattgcgcgaagaaactggccgcaacaataatgccggccaagccaacagccaccaacagcagtgatggcaccgacagatagcccttctcaccgtgacggatgtcaggcacggtagccgcgccaagcacgaacgaaatcaccaggaacggaatcatggcatagaaaatccaatgccagttcaggaattccatcaccaatccgccgaacaccggcccgatggccggagccgcgcacgtcaccaaactcaccaacccaagcatcatgccgcgcttgtggaatggagccttgtcgagaatgatgttggtcagcagcggcagggaaacacccgtgccgagcgccatgatcagtcgtgcggcaagcagcatcggaaagttcaatgcgagcgcgccgacgagcgttcccacggaaaacagcgcgatggccataacaaacaacgctttggtcgggaatttgcgcaccatgaacggtgacgtcggaatggccacggaaagcaacagcagatacccggtggtcagccattgcaccacgtcggcggaaatcgcaaactcttccatcaacgccgaatatgcgatgttcagcgaagtttccgacagaatgccgaggaaggtgagaatggcgagcgtcaccaccacgatggtgagtttgccttcgctcatacacttgtcgttgattgcgccgctttgtacgccgttgatggcggaaaccgtgccgttttcggcatgttcgatgggtatgtctgatggtgcgttcctcttatccgtagacactctgctccttcgatagaaaggttgtgtaatagtttttgcttcgaaattgtcgacgatattcgcatgccggcgcggctacagtttgcgccggcacacaccacacattacgtaaggcagaacattatgtaaggcagaaatgttacgtgaaattgcatgagccgcctacgatcagcatttcgtaggcggctcatatcagtctggcgtgtcgattatcgggttctgcgacacggtttattttggttgcttatgcgacggtgaaggtggtgcgcttcaggtcttcgcggcggctggagtgaccgataagcacttcgaattcgcccggctcaacgattcggttagcttcagaatcgacgatggtgcaatcggaaaccggaatatcgaaggcaacggtcttgctttcgcccggttcgagttccacgcgctggaatgctttgagttcacgatccgtccagctataggaggtcacgatgtcgccgatgtagagctgcactacttccgtgcccttgcgatcgcccgtattggtgagggtgatttcggcatgcacggtgtcggtttcggcgaacatgccggattccggaacattggtgacggtcggctctccgtattcgaacgtggtgtagctcaggccttcgccgaatgcgaatgccggatcctgcgtgaggtcggcgtaacggttgccgtgctggccgcgaatctggttatagtagaccggcagctggcctgcgtgacgcgggaaggtgatcggcagtcgtccgctcggctcggtttcgccgagaatgatttcggcgatggcctgaccgcccttcatgcccgggcttggagcccacagcagagccgaagtgccttcggccggtgtttcgtcaacaatcacaccgttggtaccgatcacggatgccggcagcacctgcggcttggagctgacgagcaccaccacgaacggcttgccggtttcgcgagccacgttcgacagcgcgtcgatcagtgcattctggccgccgagcagttcaagcgtagcggtggagcagccttcaccaatggcttgaatcacatcacccaccacggccacgatcaggtcgctttggcgagcgttttccacggcttcatcgagcagtgcgcggtcgagcttggcggaaacgccgatcttcgggcgaggctggccatccgggtagaactcgccttccggatcaggcaccaaatccacgatattggcaccgcgggagtacacgacctcgcagccttccggagagagctgcttgaagccatcaagcacggtggtgatcatctcgcgcgggtggccgtcaggcatccagttgatctgaccggagctgcccgcccagtcgcccagctgagtttgcgcatcgtcggcaagcggaccaacgaccgcgatacgcttcgcgccagccgcattgaacggcagcgaaccattgttcttcagcaatgccacggcttcgcgagccacttcgagattgagctgctggtgttcttcggagccgatcaccgcattgatgcgttcctgatcaggcagacgcggatcttcgaacagtccaagacggaactttagtgcgagaatacgagccacggcggcatcaatcaacgattcgtcaagcagaccggtcttcacggcttcgatcgcaccctcgtagaacttcggggtggtcatcaccaagtcgttgccggacttgaccgcgtcagcggcggcctgcacatagtccggcttaaccttctgctcccatacggaacgtccgacgttgtcccaatcggtgataagcgtgccctgatagttccaagcgccacgcagcctgtcggaaagcagccacttgttgaaggtgaccggcacgccttcgatggattcgtagccaagcatgaaggtgccacagccttccttggccacgcgttcgaacggcggcaggaaccaggattccagcttgcggtggctcagatcggcttcggaagcgtcacggcctccctgggtttcggaatagcccgcgaaatgcttggcgcatgcgagaatcgcgtctttggcaagcggctcgcccgccttggcaccaccctgatagcctttgacgatggacgatgccatttcgccgatcaggtacgggtcctcgccaaaggtttcgcccacgcgaccccaacgggtgtctcgcgcgatgcacagcaccggagagaacgtccaatgcacgccggtagtcgacacttcctcggcggtggcacggcccgcggcctgcactttttcggaatcccacgtggtcgccatgcccaattgttccgggaaaatggtggctcccggccagaaggaatagccgtgaatgcagtcgtcaccgatcaccagcggaatgccgagacgggttttggtgttcaccgtttccacggctttcggcaggtcggagggtgaggtgtgcagaatggaaccaacatgcttgttgacgattagatcgtccaagtcgccgcttcgcgcgtcaagttgcatcatctgtccgactttttcctcaagggtcatacggccaagcagatcggcgatgcgttcctcggtcggaagttccggattcttatagggcagattcgcagtgttttcaatggtttcggtcatgggattgctcactttcctcattgaagcgatttcctttaattaccaattggtagtttaacacgatgcaggcacgcacgcaactcaacatgaccataccaacacagaaggcgagaagcccgtcagccccctcgccttctcacacgaatacatgcaatgcaatcttaaataatcagcgatatgcatcccataatggagcgggaaacagcatgttttccatctgagcccactctttgcacaaatcaacttcaggttcacgcaaccaccataattgcacgccatccatgatttccatggccttacgcaccaccggacgcatactcgacttccacgaacccaattgcggaggaatcagccaaggatatcgcgaataatgctcccaaatatcgtccatacgggcagtgaattcatcatgcaacggatgatcaggattcaacgactccgcagaaagcacggtaaacaactgcaccatcatgcgacgacgcgaattatgccgcaccaaataacgcaaatacgcaggaaacagcggcgcagtaggatcactgccaggcataccggatgcgaagaaatcctcaggagtgcccgtctcaccgtaatattcgttgaataccatcgccagcatattgtctttattgcccacataccgaagcacaccctgcttggagatgccaacacgatcagccacatcctgaatggaaataccgttatacccacgctcgctgatcagctgcaccgcggcatccagcacttcctcacgccgctcctgcggtgattttcggatacgtttcggagtctcttcctctgccatgattccgagtctaatgcaccttatgtcgattgccgttgattgactgactatggcatgtcatcgtgagaggtatccgcccgaatccatccatgacgccatacgcgagtcagatcccacgcctcaagattgccgccgttgcgaggatcccgcggcggtttcccttcgccactacccggtttcgcggagcgcgcaagctggtagctccaatagatccgtcccgccgacacgtcccatgccgcgcgttgcaatcgtgacacttggcggtatgcagccgatcggttttggctgtgtagggcccactgattctccacgcaccactcgcccaccagcacgggaatacgacgagccgccgaacgaatggcgataccgctcgcgcccaccagcatccggtacagccatggcagtcgccgcgatcgcaggtacagccggcgtgccggtcccgaaaacaacggatcctccatcgcgatgagatactgatgggtgtcgagcatgacgttgcgcatgccagcacgacgaaaccaaccgccccagcggagtagtcggaaaccgtcatggaatacgatcacggtttccggacgcagcacggcgcgcaaccgggcgtaagcgtcgcggtagaaacgcttcagaaaccgcagtgagacatacgtgctaccggaagcctcatgagagtctttcgccgtgttcgacgtgctatggaacaccgaccagctcactggttcgttgagtacttcgatgctgtgcagggccggttcgtcgcggtatcggcgagccaatcgctccagcacgttcagcgtgtactccaccaagtccgtattctgcgcccatttgcacacacccgtcagaccgccgttgtcgaaaccattctgcgattcgggaacggtatgcaggtcaatcataatcttcaatcccgtctcccgcgcccaacggaacgcgcggtcgaggtacgtgatgcagcccggatgcccgggccagtcgccgaagatgaaatacggtatgggaatgcgtacgaggttgattccgtgaccgacgataatacggaaatcctccagggtgatgtaggtttcgcggtgccggcgcagttcctcggcgagattccgttcggaccagagggatacgtgcgtgcggtgcatccagatttcatcgtcttcggcgctgcgggtgaacggtttcggatccatccatttctccagcaccagccagttgccgaggttcacgccgtcgattcgctcatcgatgcctagcaccatgcgtctcaccgcccttacgctcgggggttgcccgacttttcgtttccgtccatcacaacccatggcaaaacccattcggcccaatgggccaaggaaccgtgcgtcattcgcaacattccttggtccattgtatgtgccccgcgagcggccacacggccgctcggaatcggatcacgaccggatcagggtcgttgaatgatcgtggtggccgcccgggcgggatcagtcgacaggcttcgtttcgtccgcctcataatcgaagaaatcaaaatcggcggtcttctcatgcagcgaagcatcagtgacggcaataccgaccatagtgccggtgaactcaccgaacttgcagtattcgtcagagaacgtggtggtatcgaaatccggaccgatcttggtccaattctcgccatcataaccccattcgaaccaagtgcgacggccctcaatgttcaaacggaagtaaatcggcttatcttccacggcaacacgagtgtcaagcatttccgtcttttcgccgttttcgagacgcacgatcgaaatcgcgctgccgccaagcgtctgcgaataatacttgcgcaggaaaatgttattcatgttgtcgtagtagatggtcaagccagcgctgtgctggtagacttccggctcgaactccatcttggtggtcaccgtggcatacacgctcgtcagcttgcgagtaagcaggctcgtacgattcagcgaggcaagcgattcttcaccgcgaacacgcagccagcccgggcgttccgtagcattcgcaaacgtgctcggcatctgacgcggcgagtaataccagttgcccaattcgccgccatcaaagtcatcaaagttcggaatctccggcatcggcacatccggcagattcggttcctcagcctcaatcttcgccagattggaaccgtcagccatacgcagccagccatcagacgtccactgcatcttctggatagcggtttcacgaccaagcgtgcaacgcaattccggcacaaacggacggctcgtcaaatgcaccaaataggtttcgccgttcggcaggtcaacatacgagccatgcccggacttttgcagcacggaatccgggttgaaatagcgcggcttcagatgatcgtcatcggcacgctcgttcgactccttcggctgtgacgtaaccagcgggccattcggatccggctcgtacggaccccacacattgcgggaacgccccatggtcacggaatggttgtagccagtaccgccctcagcgcacataatgtaataccagccgtcacgcttggtcagatgcggagcctcaatgcagccacgatcagtagcaccacgccaaatacgcttcggatagccgaccacatgtttggtttccggatcatattccacgcagcagatcacacccggcttctcgtagccttcgcgggtctcccactccaagctgacgatgtacttcttgccatcatcgtcatgcagaatggacgcatcgaaaccggaggaagtcaaatacaccggctcgctccacgggccttcaatattcttcgacttaataagataattattcacgtcgaaatagcgtgcattcatggaattcataacaccataaatcacgtagaacatgtcctcttcctcacaatacgtgaggcaaggagcccaaatgcccttagcgctcggcagcttggtaaggttcggattcgtatcatcggtaagcacatgggtgagcaattcccaatgcttcatgtccttcgaatggtagatcggaatgcctgggaaccattcgaatgtggaaacggcaacataatagtcgtcacctttacggcaaatggccggatcaggattgaagcctttaaaaataggattctgcagcattatttctcctttgatttctgcttttcttttcttacgtttttctcattgctgaacggggaaccagttttgcgctatgcagcggccgaggtcccaggcgtctcagccgatccagccaggggtgttgaccgtgtcggtgagcagcttgtagttccagtagtagaagccgctgccgttgctccatgcttcaagctgtgacttggcaacgccttggtagagcgcacgcttttcttcggcactgagcgtttccgcctgcgcaccttcctcgccgttgagcacgctctgtccgccgtgggtgtccacaccacagccgaccgagttgaacaggcaccactcgcccacaatcaccgggaagtattcgctcatttcggcgaccatcggagcgtacgtgttgcgcacgaaatcgtcgtagccttccacggtctgcgggcaacccatcatttccgcggccatcaagtactggtgggtgtcgaggatcacgttttcgaactctgacgcaagcttgccatctgcgccacgcatgaagtccttccactgttcgatatcgaatccatcatggaataccacagccttatcagtcggcaaagcacccttgtcgacgtcgcgcaggcgacgatatgcggtgatgtagaagttcttgagccagtcgaattcaatcggaccggtgccttccgcaagttcggcatcgacggccttgtatcgttcggtcacgttcatcatcggccaggacgtggtggtgttcggctcgttgatgatttcaatgcccatcagcggttgttccgtcgaacaatgtcgggttcattcacttttccagaaccagccagttacccaggttcacgcccttgatgtaattgaggtccatatgcactcctccatacgttttcgatcgcagtttctattacttagtaaccacttagttaaatgataatacatttttcttccttatgcaactcgactacacgaaaagcctctttcttgcgggaagaaagaggcttttacaaccagagagaaataattagctagcaaagcgtcacgcgaagggcattcaccgaagcggcgggcagtgccaccgtcagctcggcgccgccagcggattcacgcacggtcacagcagtatcaacatccgcggtatgggtgcgcacgagatccggataccccacagtattgcaatcatgcggatcttcggaagcgagcgtttccatcgattcgactttggctccgcacggaagctgcaatcgtacttcagcagcatcgttcatgtgtgcattagtcagattgaccagcagctgagtgccgttttcattgcgtgacgcaaacgtatacacggcggaatcttcggaatcgttgcgattcacatcaagtgcgatcatgccacgatgcgccctgtacatcatgaatacgtcatagttaggcgtaaggatggtccgatcgccttcagtcaaaatcagtgagttaagcacattgatggtttgcgcgttgcacgccatggacaccttgtcgcagttgcgctgcagcagatccaacgtaagcgcggtagtgatggcgtcacgcatggtcacctgctgcttaagcgccgggcgcgcaaagaacgcggtcttatgccaattgccccactcaccgataatcagatcgacatgcgaaagcttggaatccatcgccacttccggctcatgaataagcgccaaaccatcgttcatcaaacgccactgatcacacagaatgtcttcaagctcaaggcaaccctcaatcaccgtgttccagccgtcttcatcgaactcggtcggagtatcagcatcgttatccacattccagttgtagaaatgcagatcataaccatcgattttcggctgacgatattcggcaagaccacggaagaagtcctgggtccactgcacgcgttcgcgcggcttgttaccgtcaggaccgctcgcgatggcatacatttccgtcggcgcgaacacatcggtggtgaagcttggcatagcggatgcgaacctgcggtattcgtcaaggtaggtttgcggcgtcatggtaccgcctccagcccacacttcgttgccaatgccccaatatttcacaccgtacggtgctttatggccgttggcctcacgttccttggccagatcggtgggctgctcacgattgcagtattccatccaatccttcatttcggccacagtaccggaaagcatgttgatattgatccacggttccgcgccgatcatttcgcacaaacgcaggaattcgtcggtgccgaagctgtgatcgtcgagttcgtacgtggcgaagttttcattaaaggtggttttacgttcgctttgcggccccacgccgtcacgccaatggtaggtgtctgcgtagcaaccgcccggccaacgaataaccggcggctgcaatgcacgcaaagcatccaatgtggccttgcggtagccatgctcgttttcaatcggggaatcctcccctacccacagaccttcatcaatgcattcgccaaggaattcaatgaattggccatgcagtttcggatcgatacgaccaatcgtactattcgggtcaatgcagacaaccatggtttgctcctttgcagtagtactcacatctgcagtgttcgtaattcgtacagttcctgtagttattgtgccgcacaatatgtgcgaaatggccgaagatcccaggagagataatgaaaggatctccggccaagttatttcggaaaatgccgacgctacttcacctttttaatcatcagaatgaagacgcaggcgagcgccaccatcacgattgccgtcgggaacaccatggcataggagccggtggccaccacgatggcggaagtgacgatcgggccgaccatctgaccgagagtggttgcgatgttcagaatgcctagatccttaccagcctcttcctcgttcggcagcacgtcaacgttgagtgcctggtcaacagagccgtacatgccgtagccgaagccgccgatggcggagaagagaatcatacccagcgcattatgcatgagccacggcagagcataaccgatggcaagcagcacgcttgcagccacaaccggaatcttacggcggccgattttgtcggaaatcggacctgcggaaagcgcggaaatcagggagacaaccatcagcaccaagctcatggtggaaatggtgactgcggaatcttcaacgctttgaccgatataatcctgcagagtatacagctggtagttgaggatcatgtagtagctgaacagcagcagggaacgaccagcgaatgccagccagaagtcacgagcgcccttggtcggcggacggaagctcatgatgatgcccttgaaatcgaccttttccttaggcatgtccttactggacttttccttcggccagaagatcacggcaagcacaccggaaagcgccatggccgcaccagcgacgatgaagcccgggagctgcagggtgatgaactgcgcaccaacaatctggccgagtgcggaaccgaaaagcgtacctgcggagatgaatgcagacatggtgccgcgcatatcttccggaacacggtcggatagggatgcgatgaccggcgcgatcatcatgttcagaccgaccatggaaatgcagtagctgacaccgatgctcacaccgtccggcaaaatgccgatgaggaacagcgagataccagcgacaatgccgcccgatgcgatccacggcgtacgacgtccgaagatcgagcgcgtacggtcagacatgttgccgaccacaaggttggaaatcagcgaggcgagtgccgttgccgaattaagcacaccaaagatggcgtctttgctgtcgggcgcgatatcggccaaacgctgcggaagcaacactgcagcaacgatctgcaatgccagcatccacgcgaatgagaacacgaagaacgctacgcagaaacgcgttttgtcaattttggaaagcgtgcgagtgctttccgcggactgtgcgccagtcatgcttatctccttatctttcttcttcgaaatcagccccacgtttttgccgaatcttcaacgatcgcgcaagcaagagaggcgttgattgaagtcgatgtccatcggcttcgtcagttatcttatatcttataagtataagataacaaatcggcgtgtcgaacaactacccacttgcaaacacatcaatcaattacataaccgcaatatcgaaaccacacgaaaacacacgtgggcagcggcaatagtattcttcaaagcagtatggaatcacaggaaaaaacatcagcaaacagcatcaagagccgtccaatcaaccaaagaaaacgactctccccaacacaacgacgcaaacaggtcgcacaagaagcggtaaccctgatcacgcaatacggatcatatggcttccccatgcaagccttggcggacgcggtcggaatgacactgccaggactcaaccattacgtcaaaaaccgcgaagaactgctctcattggtcatcgaaacgttctacgactccgaagaaagcaatgcacccacgacattgggcgcaaccatcaaccactgcgaccaatcagattcagcaaccaaagaatgtcgacatttgcccagcgcactgcacgaaaccgtatgtttcaacgccaaacgtcctgaactcgtcgcactattcatgcgcctcgcaatcgaagcatccgacccgcaacacccggcacacgagttctaccaaaacaggcacggatcaatcctaaccgacatgaccagcgtggactgggaactaccggaagaataccgagatccagaacgcctgcacgacctcatcgtcaccgcattcttcgccatggacggcgtgcaaatccagtcgctgaccaacccaaacgaatccatgatgcaactttgggaacgcgccgaacgcattctgttcccctcccccacctgggacggctaccgctaaacagagcgcgacaagcaaaaacactgcaaaacaagagcacagcaaacaaaaaaggcgtctgtctgcggtgaccagtaaccaatcaccacaggcaaacgccctgcaacacaacaccggcttgcgaaggtggcaggaagagaagggaaaacccaccacccggcattcaacaaaccgttgccacaaccaagccgacgcgttacgcacacattcgcatcagccaagcagctcctgtcagtccagcacaaacgtgttgaacgaacgcggagcaagcgtcactttgataccgcgatcggcattgcaaggatcggcaaattcaaacggacgctcctcttcgagagcgttctgggccaccaccacaatggtgccatccggattacggaacgcaatagccatcgaattgaaatgccccgtagtgccaagcacatgcgcacccggcttgacgaaatgcgagaaatgacgcatcacataatattccggattacgacgaacctcatgcgtatccgcagtaatggtgaacagtgaattctgccaccatccccacgtggaatcctgatcgtcaagaatcatattccaatacgtgtaggcagtcgcgccattacgcaaataatggttgatcaagtggaaaatatactccgcatattcccatgtattatcgcccataccacattcggattcggactgaatcagctcaatctccggccaagactcatgcgtacgtgcaatgcaattctggccagcccactggtaggcaatgcccttgatatacttgcgagcaccatcatcgaacagaatattatcgacgaaacggttgtaattattcagcttcatgccgtagccgccggtccacgccatatcttccggaccattgagcgtgcccagccaaatatcggtgtcaagaccagcctcctcaaaagcaggtccaagataatcgcggatgaacactttgagcgcttcggcatcccacagcgcactcgggaacttctgatcggcgaacacctcattctgcacatgcagctgattcacggtaatgccatgctcggcataagcctgaatgtacttgacgaaatacttcgcatacgccttcagattctcaggagtctgcaccaaacggccatagttgtaagccttcggacgcttcatccacgtcggcgggctccacgggctggagaacagctgcatgttcggctgccattcctgcgcgcgatgaatatacggaatcagcgtctgctcatcatgctcgacggagaaatgctccatctcgtaatcgccgtcggtctcgttatagctataccaatgatcggcgaaatcattggcgccgaccggcgcacgattgaaggtgaagttcatctcatccgggctgaacagttccttgatgatctgatcgcgttcttcctcggtgaccgtctgcagaggaagccagccaagctcgttgaagcagccgccgaagccgcgcaacgcctgatattcgttgccgtcaagctgcagatcggcagcggaagtggcatgggtggattcgatttctgatgatttgtcggcaagcttgttgtcttgcgttgttgcgatccaagtagtcatggaaagtccttagtatcgtcgttgattctttggttttatttttattcgtttttgagttgttttatttgattattgggatttagttatcgatattgagttttgagattgaattattgagattgaattattgagattgaattatcggcaacgcaatttcatttcagtaagtgcaaaaaccgcaggatgccgtgataatctattcacggcacgctccaggccgccctggccaagtctttacggtcttaaacagattatcgcggcatcctgctcgtaacgctatgacgttacgtttgcactgttatttagttttggaaaactccccattccctctctccctctcctctctcgaaattgagaggagagaggggagggaggtgtggttacttgaccttcttgatggccatgatgaagaagcagccgatgatggccagggcgatggcggtcgggaaggcgaagttatagccgagggacaccacgatggtggacatgacgaccgggccgcacatctggccaagggtggtgcccatgttcagaatgcccagatccttgccagcttcttccttgttcggcagcacgtcgacgagcagagcctggtcgactgcgtagtagacggcgtagccgaggccagcgatgcccgcgaacaggtacatgcctaaggtggacggaatcagccacggcatggcgatgccgatagcgaagagcacggaagctacgacaaccgggaccttacggcggccgatgagatcagaaaccggtccagagataaaggagccgaccagagacatgaccatcatgatcatggagacgacggacacggtgacggctgattccttaacggactggccgatgtagttctggatgatgtagagctggtagacgttgatcatctggtagctcatgagcatgcagaaacggccggcgaaagccttgtagaagtcgtgggcgccagcgaacttcggcgggcggaaggatacgaggatgtccttgaaagagccctcttccttcggcaggaagtcagcggaacgttccttgggcagaatgatcaccgcaacgataccgccgaggaacatgagcacgcctgcaacagcaaagccgacagtcaggttctcgatgaagaatgcaccgatcatggtaccaatcggggcgccgatcgtggagcctgcaccatagaaggcggacatagtgccacggatgccggacggcacgcggtcagacagcacggcgaccagcggggcaatcatgcagttgaggccgaacatgcaggcgcagtagaagatggtgagcagcaccgcgttatgcgtggtgccggtcaggaacagggtgacgccaccgagcaccgcaccgaaaacgatccacggagtacgacgaccgaacctggagcgggaacgatcggagaagttgccgaacatcaggttagaaaccagggacgccactgcggtgaacgcattgacgataccgacgagggcgtccggatcggcgccttcgatggtcttgtagtgcatcggcagcagcacggcggagacgatgccgaggcctgacatccacaggatgccgaacaccaggaagccagcgccgaagcggatggtgttgaccttgctcagcggcttgccggtttcaggagacagcgacggatccttgtccgcggctgcgatgttggcgttgtacgccaccaaacgctcctctttgcttgcgattgcttcactcatgaaactctctccttcgattcatgtttcagtagtgtttttgttgtgtgacacggactgccccgcccagtcaattaactaccaatcagtaattaacgtatttgttaccgtaaatcatttctgccaaaagcgcaagtcaatcgtgttcgatttgttgattttgcgaatccgacaccatgattccatgtttagttttactcttaagcagaatctcggtttttattacctagtaactgcttagttaaagcgtattacaatctcttttatctgtcacttctcagcgtgttccaacgtttctgccacacttcctctcctccgtactgtaacttagtaagtacaagaaaaggagagagagcatgcgccgccgaatcgaagataaacgcaggaaacgaatgagcgccgaagatcgcagaaaagcgatactcgaaaccaccgtttcattcatctcccaattcggcttctggggattcaccattcgcgacgtggcacaagctcagaacatcaccgaagcaggcctcctttactacttcaaatccaaagaacaactccttgaagaaaccctcaaatacgccgaccgcaccaaccaaatcgccattgcagagcatcttggcgttgaaggcgtgaccggcgaagttttgcaagacggcatcgcataccattgcgctctcggactcaaggccatctccacaggaaccgtggaaaccaacgcagaccgacccgaaatggttcgtctctacactctgctcgaaagcgaggccctaagcaaagaccatccggtgcacaagtatttcgaacagcgcgaaatcaatctgctgaaggaatacacgttcgcagccaaacgagatgacgtcgcctatccggaacgcaccgcactgcaggtgctatccgccatggaagggttgcaattgcggtggctcaacggatctcaagatgtcgatttcgttggggaatggaaggccctgatcgaccttctcattccctaaacgttctctttgcggcgatttcagcctgcgatcaccacaacattccagcggccgattgccaatggatcaccctccttgacggctgtaccctccttcagtacgacttcagcagttgcagcctcatcaatattgccgtcggtggcgatgacgaccggagcgaccaccacttcacctgcaaccgggcttgcaacggtaacttcgtcggcggaataattgagcagatacgtcacgttctcgccgagggcattcacaccctgacgaaccgagatctggcccgcgagcgcggttccggcaacgacaacaccagcatgttccacagcctcgcgcataaccgcacgaatggaatcggcgtcaagcagcgtagcaatccactcggcatcgcccttgccgaatgcgtgacgggtgactgcggcgtaatccttccaagcatagtggccgtaggatgcgagcacctcagtatcagcgtcggcgttcaacagttcgatcagcgactgagcatcggtggacgcggtttcggcgagcgcacctgcgaattccacggaaacgtggccattcgggcgggtgaactggctgtaagtcatgccgaacacgtcggtgagattgtgcggagcgcggtcggcccaaacggtcacttcgtcatcggatacgaaagaacgcatggtggaaaccaagtggccgccattttcaacgaacgtacgcaagcgatccgtagtttcctgagacgtgcagtagagcgccggagtcacgatcatctcatacttggcgagacgttcggccggagcatcggacggcacgaaatcgcattcgacgttgagctcgaacagcgcgtcgtacacgttgcgcaccacgtcgttgtacttgaggttgccgccgaacgggaagcccgcttcgatgaggaaccagtcgagcgcggtgagcgactcgttgctgaccatgatggccaccttgttctgcttcttcaggtgaacgaggcgctcccccacttccggcttgccgatttcgtgtccgaacacgcctgcctcgcggtaggtcgggttcggttcgaggtcgtggctcagcagacccttccagtaggtttcgaacgaattgtggatggaatgccagtgccagtattccaccatgtcagcgccggaggccaagtgcgagtaagcctgcagacgaagctgtcccgggaacggaacccagccatgctgaccctgcgcttcggtttcgagcacgaggaagttcttgccgtccttggtggaacgggtcatatcgccgccgaatgcgatttccttaccggtcagatcgtcttcggtcggatggtagatgtcgacgccggtgatgtccactgcggtcgcggccttgaagtggtcgacggccggctgcacgccgaaggaatagccacgccattcgaaatcgaaattgtgggtgatgaactggtcgtcatgagcgtattcgcgcacaatatcggactgccactgcaggaaggcacgcacctgatcgcgacggaacttgtcgaattcgccgccgagggactcgttaatcgtagcggtcacatccgggaagtcctcccaggaattgatgcggttcgaccagtagtcaagaccgaagcgatggttcagctcgttcagatcgccatcgaacttctcatacagatacttgatgaataggcgctgcatgtcgttggacacggaatcgtagtacttggtttcgttatcgacctggtagccgatcactgccggatggtcggcaacgtgggagatcagattgcggatcacgcgttcaccgtagaaacggtaggtggcattgacgatgtccatgatctggcgtgcgccatacttgccttcaccgttcggggtgaccgcgagcacactcgggtcaagcttgacgagccagctcggcactgcgtaggtcggggtgcctacgatgacgtcgatgcccgcgcgctgtgctgcgtcgagtgcgcggtcaacgtaagtgaagtcgaatacgcccggctgcggttcgcaggtgctccacgtggattcggcgatgcgaatgacgttcagccccgcttccttcatcatcctcatgtcttcatcgacgcggtcgatgcctttcatcatgaggtactcgtcgtaatatgcggcaccgaaaagaatgtgatctgcctcgtaacgactcatggatcctccatcgtcttcattgacttgttactagttactacttgttgctacgtctaaggttgttcttttgcggtatccccgagtttttctcaagtatccgtatctaacagccattagatataagaaatataaatcttcccgattcagctgtcaagaactgcaaaatttcaggcgtgtcttacctaacaaccattagatacagcgtttccccttgaccaaaaccaaccaatcaccgcaatccacacaaaaagctatcccagcgagcaaatctttccagccactggagcaagcttcccgcaaacacacctccaaaagtcctgattcttccagctagtggaggaattgagacacaaaaggccatagaaacacagctcgcaagaaaactgcacacggcttagcggtagctgtcccagacaggtgaggggaagatcatcttttcgaaggcaagccattcatcgtagaaatcgatgggaggcttacgcatccaacgcagttgaatgccgtccatcgcttccaagctttgacgcaccatcgcacgcatattctcccaaccgccgatttcaggcggcaatttccatgtgtactgggaatagtgttcccacacgtatttcggtcgattctcgaaatagtcgtgcaacggatgatcctcactgaacgactcagtttctaacaccatgtatagctgcagcaagctgcgtcggctcgcattgtagcgaaccaagaatcgcaagtacgcgggaaacagcatgccttccggatcactgccgggtagtcccgacgcagcgaaatcagccggagtgccctcctgatcgtaattgtcggtgaccagcagcgacagcaaccgttccttgttgccgatgtaatgcagcaatccaggctggctcatgccaatcgcatcagcaatatctttcaacgatgtaccgtaataccccttttccccgataagacggctcgccgcagcgacgatttcccgcttacgctcctcaggtgttttacgaacacgtttcttcccctcattagccatatggacagtgtactatctactacccattagacaggcggaaatcatatcaaaccacaacattcccactcgccacataaaaacgggccgaccttcaacagaccagccctgaattacattcaaaaccacttcgagatcacattcagtcagcctcagccaaccaaaaatattcgaaaaacagttttacttctggaacacgtcaggatgcttcggatcgccaggttcgtcggcaagcacaccttcgagccctaagaattcctgccagaattccagcgaattgccatacggagcggcctggtggccatgcgcctgcaggttcgccttcgcctcaagcacatcttcctcgcgaatgccgtcgaaatacgattcgagacgctcacgattcgccggatcatagaacagcgatccgatgatttccgtcaaccgttccgcacgcgccacaggcagcgaatcccaatgacggaattcaatgaagttcttcaaacgcacatcgttgaaatgcgtggaaatcacatgattgatttcgtatgcgttgagttctcgatcaggatacacgtcgttcgcgttctcatagaatgcaggatgatgcagatcagttccgggagtttctaacgcttccggagtgtgcgtcagatcagcgaacatcatcggcgtgctcagcacgtcaaccgcataatcttcccaaccgaagcgaggatcaaacagtcccggaataacgttcgtacgctggaaatccaaataatcccacatgcgctggcgcagcagcgggtacggattctcccgcccctcgaagtacggggtgttacggaagaaccatgcaagaatcggaccgatcaccgtacccaaacgcaacttggaaatcgcatcctcttccgaaacatagtcaatgctgatctgcgtcgaagcggagcagcgcatcatgcacggaccaaactggccgacacgacccaaatacgcggtcatcgccttgtaacggtctttcggattgacgggaatgtcggcatagccggacttcggctggtatccgtaattaaccaagcggaagccaagctcgtcaagcaccggatcgacttcgcggcggaacgctccgtaaatcgtgcgcagatcctccggcttgtgcagaatacccagcgaacattccagctggccacccggctcaagcgacacggaaataccttcgcgcccaaggccaacaagcctgccgttctcccagtattccttgctttcgtcgtaatacgggcgaatgcggttcagcaacgcctcgatgccgttctcctcgtaatagttcacggcggtatcatcgctgttatgcaccggcagatgctcgatttccacgccgaaaccgccggttccgcgctcttggcagcctgattcgaagaatttgaccagactttccacatgcttcggattcggctcagtaagcaggtgtgcgtaagaaattcgtggtgctgtcatgttggcaatcctaccgaaactcattgatgagcacggcgcgattgctatacgaaaaactgatagccaactcttgcgtatcccgaatcgagtacacattttcaattacaacagacatgctctgcaagaccgaccaataataattaacagctgtcaataaagtcagaagcaattaccactatttggagaattgtttgtatatatcaataaaaataccgacgctgaagatgttgtccgcgtcggtattttggtcaattccagtcagtgcttattgatttatctgcctatgattaggcgacttttttgctttgcgtcgtctcaccctgttgcgcggccttgtgagccttcttggcggctgcgatcatcagtttgatgcggttgagctggttcgcttcggatgctcccggatcgtaatcgatggacacgatgttggcttccggatgcagtcggcggatcttgccgaacatgcctcggccggtcacgtggttcggcaggcaggcgaacggctgcgcacaaatcacgttcggacagccggattcgatgagctcaaggatttccgcagtcagcagccagccttcaccagcctgcacacccacggaagtgacctcgtcggccttcttcacgagttccggcatcggcaggtcctgggagaacttgccgtgtgctaaatcgatcgccttgtgcacaggagcgttgtacatgtcaagcgccttgcgcatcagcgcgtagccaagcttgttgccgcccatgccgaggtaatgctcgttccagtcggaaatgtatgggcgggtggtcatgaattccatgatgcccggcaccacagcctcgcaattctgcgattcaataacgtcgaccacatggttgttggcgtccggctggtacttgacgaggatttcgcccaccacaccgacgcgcaccttgcgcggctcgtccttcaacggcagcgcgtcgaaggatttcacaatctccttaacgagcgtctgatacggcagataccccttgccgatgaacttgcgtgccgtcttggaatagccgtggtgttcgagcgtttcacgcacgatggtgtcccacgtgtggtacagctgattcgcactgcctggcgtcacctcgtacgggcgtacgcgatacaggcatttcatcagcagatcaccgataatcagcgccttgatgacacgatgcaacaatgccggagtggcggtgaagcccggattgtcttcgatgccctgcgtggaaatggcgatcactggaatctgcggatagccagcatcgaccaatgccttgcggatcaggccgaaatagtttgtggctcggcacatgccgccggtctgtgtgatggcgagcgcggtgtgttccggatcgtatttgccgtccaaaatcgcgtccacgagctgaccgataaccatgatggccgggtagcaggcgtcgttgttgacgtatttcagaccggtttccacgttttcgcggctggcgtgttcgagaatgtcgaacttgtaaccgccggaacggatcacggattccaccaaggagaagtggatcgggctcatctgcggagccacgatggtgtagtccttcatgtctttgccgaatggcacgcggttggcgtacttcgacatggtggcggaattgtgcgcggatttcttcgcttcgccgatgccgttttccgcggcacgcctggatgcggctttgacggcttcggtaagtttcggattggctttcatcacggtgtcaagcatgacttgacgtcccggagtcggcgcctcagacccggtcttgcggaattcgccctgcttgttaggcgcactgtcttgtttgttaggcatgactgcggcgattccgcgctgcttgttgcgttcgcgttcttcgacggctgccttgagcgagcgcagtcggatttttgccgctcccaagttggagacttcgtcgatcttcagcatggtgtacacgtcggccttgtcggcgaggatttcgcccacctggtcggtggtgatggcgtcgagaccgcagccgaaggagttgagctgtacgagttcaagtcccggataggaggccacgaagtttgccgccgagtacaggcgtgcgtggtaggcccactgattggtgactcgcaacggcattttggtgaccttgcggtcttccacatgacggaagccgtccgcgttcttcttgcgcggatcgtcttcgtccgcggcgaggaaatcactcaggttgagcttctcccccggctgcagttcgcagatcgaatcttcagacaataccaccatgccgagcgagcagatggtttccggaatgccatggttgacttccggatcgatgtggtacgggcggcctgcgagcacgatgcctcggcagtcgtgttccttcatgtaggcgagtgccttgaggccttccatctgcacatcgtgcttgaagacttcgttttcggcataggccgctttgactgcggtttcggcttcttcacgggtcacgttggcccaagcgaattcttcgacgatacggtcgaccatgagttcatggttggccatgttgaagtatgggcgcatgtaacggatgccctcttcgcgcagttccggcatgtttgcgccgatgaccacgggatagttggctactaccgggcagttgtagtggttgtcggtgttgggtaccaggttctcttcgtagctgacgcacggatagaagatggttttcacacccttgctcagcagccatttgatgtgtccgtgcacaagtttggccggatagcagatgttttcggatgcgatggattcgatgcctgtttcgaacagttcatgcgagcttcgtccggaaatcatcactttgaagcccagcgaggtgagcagtgtgaaccagaacggatagttttcgtacatgttgagtacgcgcggaatgccgatttcgccgcgggttgcgtttttgtcggtgagtctgcggtaagcgaagcaacgcttgtacttgtaatcgtagaggttcgggcgatcggaacgcttctttttcgcgtctccgcctcgttcgcagcggttgccggtcacgtagcgggatccgtcttggaaggtggtgatggtgagcttgcagtggttttggcacagtttgcacacgtctcgttcggaggtcatcgacaggttgtcgagttcttcgccgctcaaaatgttcgatgcggtatggcatacgcctgcgatcaccgcctctttggtgtcggtggtatcgacgtcttcgtcttccgcttcgtcggcatagtgcatgcgtgcggtcagtgcggcaccgtatgcgcccatgagtcctgcgatgttcggtcgggtcacttcacggtctgtgagcagttcgaatgcgcgaagcacggcgtcgttgaggaacgtgccgccctgcactaccacggtgtcgccaagttcgccggaatcacgcagcttgattaccttgtagagggcgttgcgcactacggaatagcacaggcctgcggcgatgtcttcgatggacgcgccttccttttgcgcctgcttcacggacgagttcatgaacacggtgcatcgggagcccaaatcgaccggatgggtggagttgagcgccgcttgggtgaattcctgaatggtcagacccatggaaatggcgaacgtttgcaggaacgatccgcagccggacgagcatgcttcgttcactgcgatggagtcgatcacgccatcgttgatggcgagatatttcatgtcttggccgccgatatcgatgacggcggtaacgcccgggctgaccatttcggcaccgcgatagtgagccatggtttccactacgccttcgtcgaggtgcaggccggtggtgatgaggccttcgccgtagccggtcgcacaggatcgtgcgatccatgcgccttcaggtagttcggcttggatttttttgacgatttgcactgctgccgtcagcgggctgccttcgttggtcgcataagaggaccatacgatttctcgatcgtcgttcaccaacgtcgctttgatggtggtggaaccggcgtctatgcccaggaagtgcggtccttgggctccttcgagcgtgccttgatggatatgctcgcgatgatgccgttcgttgaatgcggtgcgatccgcctcggtagcgaacagcggaggcatggtcggagtgttggacggcaggttttccagttcgtccagtcgtgccagaaggtcggcgcaggttcgtgcttcgtaatgcttagtcaaggtcgtcaccatcctgatcggcctgcaatgcggcaccgtatgccacatacaggtgagcgtcggtcggaacaatgaattcgtccactttgccgtcgagcgcccgcttgaacgcggctctcagttcggacatgaagaacaacggaccacccaggaagatcacggttccgtgaatcgggcgtccggaggcaaggcctgcaatggtctgcgtggccactgcggtgaagatcgatgcagccagatccggcttggccgcaccatcgttgataagcggctgcaaatcggttttggcgaacacgccgcaacgtgatgcgatcggatatagggtttcgtattgcgtggccatttcgttcaggccagcggcgtcggtgtcgagcagtgttgccatctggtcgatgaatgcgccggtaccgcctgcgcaggaaccgttcatacgctgttccggagtcggcttgagatacgtgattttcgcatcctcgccaccaagttcgatgatcacgtcggcctgcggatattccttgtcgatggcttcggtttcggcgatgacttcctgaacgaagggcacgtcgaggctgtctgcgagggcaagaccgcctgaaccggtgatggccaggcgaatcggctcgtcacctcggccaagcttttccagctcctggtggatgtcggccaatagtccggccacggtggcgcgcacgttcgcgtggtgacgccgataatcgaagaacagcgcgtccatgagcgcgtcggactgatcgagcaccaccgccttcacagtagtggaaccgatatcaagacctacacgcaacggctttgtgccgtgcgtttcggtcacggcttctgctgcttcaaccatgtctcaacctctatcgttctatccgccgggctgcattccatggcaggcatggaagcccctaccccgggttatccaatcatgtaatcgtagtctgtgcccacgcctaagtgctttgtaaatgctcgcaatcagcataaaatgcacgacacagcgcacaaattagacaactaatccagtcaacgtgcctaattatgtatctggacgctcgacgaatgtcgagatcgcaaacccttccaagcatttccatgtcaggatgcgctgccttcccctgcagaacggtctttgccgtatatttcgggaatgaatcgtgtttgatcatgtagtttcggccagatcaccacttgtccgctttccagtgatttcggcacgtcgatgatgcgttggttgctgcttccgcggaattgcagcagggaatcatgtaattctttgatataacggccatccacgagaatgtcgatcagttcgagcagctcgcgcttgtcggggctttcgccttcgcgcatgagctcttcccacgtgtagccggtccagcaccaaatatctttggtattaccgaaccgttcgcgtattttgcgcgcaaggggcaacagcacgcccgtgttgagcaatggttcgcctccgaggaaggtgatgccttgcacatacgattggcttaagtcatccatgatttgcgcttcgagcttgtcgttgtattcgtggccggcttggaaatcccagattgacgtgttgtagcattcctcgcaatggaacgggcagccggacacgtacagcgagcatcggatgccttctccatcggtcatgaggaaccgtttgtagtcggcgatcatattgcggctcatgcggttggtccattgccctgctttgggattgttggaacgagttgtggggatgaaaggtccgcgattggtttcgtccgccgcaaagtcacgacgttgaattgctggattcgcgctgctgatcatacgttgtcccttcacgttttgccgttacgtcgcgtttttgcgattgctgcttgcctcatgattgtcacagaatgaaagagggtggaaacccaccctctttcatatttcgtttatgtttgctaccgacgcggcccttacttggcttcctcgaaccattcacgttcggaaccgtcactcaaggtgacatgaccggtttcgccgctcatatgcttgacgcggtgcgcgatctcctcgtgacgtccatgcaccatcgggcgctgcaccgggttgcccaagtagccgcaggtgcgcttggtcacgttgcagtggtccgggtcggagttgccgcactccgggcacttgaaaccttcctcagtgggctcgaagtcgccttggaatccgcaatcgtagcagcggtcgatcggcgtgttcgtgcccaggtagccgatgccgatgttgtaggcgtaatcccacaccgcttcgagtgccttggggttggactgcaggcacgggaactcgcagtagttgatgaagccgccggacgcgtagtacgggaagtccttctcgtagttgagtttttccattggggttggctgcagccagaccgggtagtggaaggagttggtgtagaagtcgtggtcggtcacgccttccacttcgccgaacttctcgtggtccatacggttgaagcggtcggtgagggattcggccggcgtggagtacacggaatagtggtagccttccgcgtcgctccattccttgcacagctcgttcatgcgcttgacgatggacagtgcgaattccttgccttgcggatcccagccgtgatcgcgcatccagttcttgccgtagaacacgctggtcgcctcatacaggccaatgtagcccagggaaacggtggcacgttcgttgcggaacagctggtcgacgctgtcgttggcgccgagtcgaccgaaagctccgaaacggaacagggtcggcgcattgaccggcgcggcctgcttgcaacgcatgatacggaattgcaatgcctgatgagccacggccatacgctcgtcgaagatcttccagaagcgatccttgtcgccgtgggattccagtgcgatgcgcggaacgttcacggtgacgacgccaaggttcatgcgtccgtcttccacatccttgccggtcgccggatcaatccaaccctgcaagaaggaacggcagcccatcggggctttgaaggagccggtgatcttcacgatgttctcgtagaagatcacgtccggatacatgcgcttggtggcgcattcgagggcgagctgcttcaaatcgtagttcggatcgcccggatcggcgttcacaccatgcttgatggtgaacacgagcttcgggaaaatggcggtgtggtgttcggaaccgaggccgcggatacggttcaggaagatggcacgctgaatttcgcgggcgaaccagtcggtacccaaaccgaagccaacggtcacgaacggggtctggccgttcgacacacgattggagttgatctggtattccatggtctgcatggcgtcgtagatggccttgcgggtctgaattttcgcccacacctcacgcaactgctgcaaacggctggcatccttgttgaacggctcgtccatcggcagggccggacggtccttttcgaaatgcagacgcttcggttcgacatccttggccaagcgcacctgacgttcggcgatttcgatcggcaggtcgtcaggcatgatctcatgggcctgctcaaggaacttgtcgtaatccttgcgcgcgtattcgacgaagtgctcgtcggcacggttggcggtctggccaccatactggctggatgccacgtccttcatgatctgggtgatctgcgtggcggcgatggaaatgctgttcggcgatcccatcggcgcgttgccgagagtgaaaccgttggcgagcatatcccagtagttcggcagcgagcagttggattgtgcggtgaacggcgagtagtcggcgtcgtggaagtggatgtcacccttcatatgggcgttggagaccgcatccggcagcatggagaaggcggacgccttggacaccgcgcccgccagcagatcgcgctgggtggagtagacgttggaatccttgttggcgttctcgcgcaccagagcctcgtcacggttcaccagacgcttgacggcttcgttgatgtcggtggccttggcacgttcgatgtctttgttcagacggtagttggtgtacgtgcgcgccacatcgtacaggtggtcttcgatcagaccgtgctcaacgagattctggatgtcttcgatcttggcgggaccgttgtaacgatccttgatttcggcttcgacctgattggcgatatcacggattagctgttcctcctgcggcccgatcttcttatcaaggtcggcgaaggctgacttcaccgcgctgatgatgttgatcggatcgaagtcaaccacacgaccgtcgcgcttctcgacgagcaccttaccggttcccgttttaacggttgcggagatggcattcagagcctgcgtttccattcatcatcctttccgggtcggaccccatccgaccaggttttcatgcttcgttatgcatgccagattgttgctacgtccatgactgtacgccatagccagcactaaatgtagtagcggcacgccggcagtaaaactatatattccatttttcggcttgattccgccattccttaacttgtgtgacaaaggtaacgatttcgccacggagtgtcgcccgagtgtcgatttgacgcactcaccgaagagggactatacaaggcggggtaccctcacggaattcgaacatgtgtttcatttgtccgcaagatgatggaatcttgaactatgacttggaaccaggattacacacccccggcagcgcagccgaacagcaaaccgctgccacgactggccggcgaaaccactgctgacaacccctggccggtaagtctgctcagcgagaaattccatatggccgtcgaacggtggccatcggtttgggtggccgggcagatcacgcagatcaacaccagacgtcagggcagcgcctatatcactctgcgcgatgattatcaggacattgcgttggaagtcaacggtttcgggcagttcgccgcagccgccacgccttttgtgcagggcgaccgcgtcatcatccatggcaaaccgaatctgtggatgaaacgcacgtcactgtctttacgtggcgacgccattatcgcggccggcgcgggtggcagtctgaaggccatgatcgacgaattacgcaagaagctgaaaggcgaaggcctgttcgacgctgaccgcaagcagcctctgcccgagtttccgcattgcattggtctgatttgcgcgccgcaggctcgcgccgaaggcgatgtcatcaccaacgtgagattgcgttggcctgttgtcgacttcaaagtgacgcatgtgcatgtgcagggtgagcagtgcccttccgacgtgatcaaggcgatcgcgcagatggatgccgatcctgatgtcgacgtgatcatcgtggcccgtggcggcggcgctttcgaagatctgatcgggttctccgacgaaggcgtggtacgcgccgcggcagccgcccatacgccgctgatttccgcgatcggccatgaggatgattggacgctgcttgatctggttgccgatctgcgcgcatccacgccaacggacgcggcgaagaaagtcgtgccggacgtgcgcgagcagatgcaactgatcaacgtgaacatcgaacgcatgcgcatgcgcatcgacgccaccgtcaacaatgaaacaagactgattgaaggctatgcgaaccgtccaagcctcacacagccgctcaccatgctggaaccgcatcagcgtctcatcgatgatgcaagaacccgcatgagaatcggtctgacacgtattcttgacgacgcaagcctcaccatcgaaaaagcgcatgcctcactgaccgcgcttagcccgcaatccactctcaaccgaggttatgcggtagtgcagggagcggacggccatgtaatcgacgatgcgaacgccgtgaacaccggcgaccaactcaccatgacattgaagcacggcgtgatcgtgtccgaagtcaccaccgtaacgaaggagtagcaatgatcaacgaaaccacccccgcatccagcctgaccgacaaggaacgcgaagccatcgcacaaatgccttacgaagaggctcgagatcagctcattcaggccgtgcaggcacttgaggccggcggactcaaccttgaccagtccatgcgccagtgggagcttggcgaagccctcgccaagcgcgctcaaagtctgctcggcgaagtgcgtgccaagcttgacgcagcccaggcggaacaggccactgcggccaataccgctggaacgcaagacaatctggcctgaaaatctcaaaaaccgccaatatatcgtttctacatgactgtgcgccacgtacttcatgcagcgcacagtcatgtagaaatttcggatttcttcatttcggcaccacactcgtccggatggtgtgtagaatgaagattcgttgcctcagtagctcagtggatagagcacttctctcctaaagaaggtgtcgtaggttcgattcctatctggggcactttgttttatgcggatacgcagccgatacgtagttgcgccggcactcttctcacacgtcgaattgcacggttgccagcaacgccttgtgatcacttccgtcgattttcaacgatttgacccgacctgccaacatgccggaatccaatacgatatggtcaatgcccgcaaacgtcggcacataatcgatattcgcaggccacgtgaataccaatcccccggccgcttgtttggccgcatccgcgaaccgtgttcccaagaaattacggaacggtgcatgatcgtcggtcgcattgaaatcgcccatgaacacgtacctacgagacgtatcgtaccggagtcgaccaagctcatccaatgaacgcttccactgctgccaatatccatcggtcggagacgtggtatgcaccgaaacgaaacggatctgcgtctgaccatcattgaatgcaaccgtggctcctggcatgaacgacgcgctcgaatcaacatcatcatcagctggatcaacaagcggacccgccgaccacaaaccattgccatacacgccgtctgagcttgccacctgcgcatacggcagcaaatcgccaataccagccttgttcaactcgtccacgaaagcatcggtcgtttcttgcaatgccagcacttccacacgctcgctacgcaccacatcgacaatttcctgcgcgtcggcacgacccttaaacacattgcatgtcatcaaacgggcataatcatcctgcgtattggcggacgctcccgaaaccgctgcaatcgcggcacgcggaagcttcgtctcattgtagaaaaacggatactgccaccatacttgcaacgcgatcgccgcaatcgccagcaataccgacatcgttcgtttcgagacaatgccgcaaatcagcgcaatcaccgcaagaatcgcaaaccaaggcaccaacgaaacgataatgggaacatacggccacgcctgaatctcagcaggcagtatgtgcgaaacagtgcccagcaaagctgcaatcgacagaataccggccagaaaaccgcatatgatattgcgcacgcaatgcgacttagttttcttcaacgtgcgaataggcttaacagccttcgcctgcgccgtacgcggtttcgtaggcgtaccagaccgtgccatacatcctccaacatgggcattgcgttccatcagtcaatacatcaatcatcaaatcagccatcaaaaccgagttcatgacgaacgccatcggcaatagtgcggcttcatagtaccccaacttccacattcgctggcaaatagtcgcaatcgtctccataaatttaacgaaaaacaatcgaaacacaaaaaatcaccatcttgccccaaccattaaatactattacgctggacacataagaaatcgtaactaatgggggtacgacgccttacgcaagagcaatggctgctcatgtataccgagagggggctataccatgctggaacttgatcacgtggggttttcgtatggaaaacgtctgattttagacaatgcgagcgcattattcgaagaaggttcgacaacggcaataatgggaccttccggctcaggaaagaccactttgctgcgtttgatggacggttctttacaaccagacactggctccgtcaccattgatggcgcaaatgtcaattccattgatcgaaaaaatcttctcggatctttatgtatgcgcatatttcaggattacaggctcattccatatcttgacgtgcgagaaaacatcatgttggcgtttgaagcggcgcataaggacctcggacaaaccaagattaaggaaacttcccgcgctgaaagcaacacaatcgataacttgcttgaagaagtgcatttagcaggctatgcaaaccatttggctggccaattgtcaggaggagaacagcaacgtgtggccatcgcacgcgcgatcgccatgaaaccacgtgtgattctcgcggatgaacccaccggcgcgcttgatgaggaaaatacgcaggcaatcgcaacattgctttcagatattgcccacaaagagcgatccattgtcataatcgcaacgcatgacactacggtcgcgcagcacagtgaccgcattgtgcgcattcaggaccacaagttggtggagcaatgaatggcatgccttaccacagcattggaatcacgaggcacgttacctctggatatttgagattccatccgatgctcaccatctcactctttgtggtggcattattgtcggcgatgctacccgtggtggccttaaacagcttgaatctatacgtacaggctgccaaagaaggcgcagcaggtcaatccggagggtacacgtaccaaatttcaggaggcagcaacgatgtagccgaagaactcaggcaacaagtccaaaacggtaaggccatcggcgtcaaatccacacaaggatcagtaggcctcacctccgccagcggctcttcacgaaacaccatcgcagacataactttcctaacaggcccctcacgatatggcacgctcatcgaagggcatcagccgtcgcaaaaaaacgaaatctccctgtctcgggccgcagctaaacaaattgacgcccagctgggagatatagtcaccgtgcaatgtgacgattccgcattatcaagcgactataagctcattggcatcaccgtcgatgctgcgaacaccaacaccgtgtacgcaacagcagtgtcttccaaagacaatctccaaaacatacaaatgtggctcaccgacgatgacgctactgtaaatcagggagaagtcgcaaaagagagcgcaaccaacaatgtcaatatcggatacatcaaatcgacaatacgaaatgccgaagaaacggttcgtactcgcgatctgccaggatgccaatggtacggaatagttctgttcctttgcttgctgtgcgtacatatcgcagtaatgacggcattcttccgagcaggtcagtgttccggagatgctgtggtagaagctctggtagcttgcggattccccctcaccaccagcagatggacagtgttccgaggattgcttatttgcacaatacccggagccgcaattggcatcgcggccggatatgcggtattcggtcttagttacaggaccataggcaacatattcgcccaatattgggaatggcaaccatcagcaacttccctgctgtccatcttttttgtcgcagcgattttgctgtgctcgctatgcttgacatggttggttttgttcttccgcatgtcctttaagcatgacatcacaaccagaaacgcattatggtacatcattctttcctcggccgttctgctgttttcttgtgtggcgatagaacgttatcatgcagccgcatggccgtttggtggatcagtgggctcggtcatgggggcttgcgctctgggacctatgctcctttcactgccttggcttttccgcacgccagcacaatgcaatgcgatagaacgtacacgaagtttgtctgccccagtatgcgcattggcactcttattgttaggtgccagctcattgttcagcgggcaaatgatgatagcgacaggcaattcggataatgggctgttcatcgccgattatttgactcaggatgacttaaactatcttgccggcaaatatcccgagactctagacaaagccatcgtgctcacggcaccggatgaatcccggtatctggtccgcgccgcgacttcccatgcttacgattgcgtcattcaacatggttccgacgatgcggattgctactcagattccgataatgaaaccactgtcatgcttgttgatagcaactcgtctttagccggtaaaaccaacgacgttcatattactgaaagcggcaacactggcatcattctcatcgatcccgcaacccaaaaaataactcaagcagcacaagtatccaccgagggcaccgactcgctgctcaatgattacaccatgcccggcgtggttcttggaatcgactcaccacaagcaaaaacgcttggccttacgccaagcaaccggcatactctcatcatgaccgatttcccgtcaatcgcttccggcgttcgcgattcaatccgatccgacatcattaaccgttgcgggtatgcattcattaccgaacacgacaccacctcttaccgctcctacatggcacgcgccattgccataccagctttggccacaattatcagcggcctgacattcgccgcattggccatatcaacacgtcaaacgcagtcaacattacgctggacgcttcaagaattcggtgcatcacgattccagctcatgcgtttgttcagacctttaggaataaccatgtcgttgggatcaaccatagccgtattcttggggtggctgggctcgcatccttggattattgcgcccgcgaacgaattcggcaccactggctggtggtggctcataccgctacctgtcatttttattgaaacggcattgttctgttggtggttttcgctgcccgagcgccgcaatcagtgaccgccggattcgccttcgcacataatcggaccataattggacttaggagaatcgcgtaataaaaaatcccgaggagcagtgctcgactcgggattcaaaaaagtttaagtgcggcgacgtgctactctcccacaccctctcgagtgcagtaccatcgccgtgctaggccttagcttccgggttcggaatgggaccgggcgtctcacctaggctctgatcaccgcaagacgaaataatacgcacacatgcctcaatcaccaaatcacggcgtgtcgcagattgcaatcgtctatcgcagccgcacggcatggcgaacagagcacgcttgcgccgatacgccatcccacttgcgtcgcggatgtcggatcggtggtggcggcacgtgtgcagtcggcgccgttggccgcacaggaggtgaatttgggtgctccccgatcgtcgaccggatcgccacaaccggctttgaccaaagaggcgacttgcacactggaggtgacgggcttgacgaacgatccgccgataccggttcccgcgatgtccgaaaaaatgcattcttttgctcaatatatggagacatcatccacgcgcagttttatagattcccgccagtcacataccgacgcgccgttatcaaaatttgcggctcttgcgactactgttgccccaataaccgatatgaaagcacgaaagaaggccagcaatgacgatcgcctcctgcggttccgtttccgcactcacattgggtctgccgaactcctctgcggttcccgcagaaaaggcaacgttgccgaaaggcctgttcgtggcgagaataccggtttcagccaaaacaaaacaacgattggcgaacgacatcgagacgatcaccatgttgtctctgctgcggccaagcaatacacggcttgccgtcggaacacgcattccggaagtactggcaatcggattgcgcctgcatgccaagaacgccgccataccgacggatatcgtcgagctgattgccatgcaacgcaagtcgggaatcgtgttcgtatgcgtgcgcgacgccgacttcgaaggtacgaagcggcaggagtgcgcgttcgccgtgagacgcgcgctgccgggacgcgccggtcacacacctacattcaaagtgttcgtctcagattggaaaccggccggcgaagcgatgctggacatcggcgatcctgcggtcgattccatcgacgcgctgtgggagtcgttatgctcgcaggtgacgctcggcagcgcctctcccacggcactggacgcgcgcatgacacggcgtatgcaggccgcacagcttaccgagcagatcgataagctcacgcgcgatcaccaacgggcaaagaatcccgaacagcgcaacgaaatcttcaccaagctgcacaaggcgaagaaccagttggaggaactgaggaagctggaagcctaggaaccgctagaaaccaaggctcgtgcggccaaactggtcgagccagcgcagaatagccccttcccgcaacgcccatgggcagatttccacttccttgacgtcaagcgccttcatgatctcgtcgatcaccaagccgccaccgacgatctgatacgtgcgctccggcgtgacgcccggcaatgcggtacgctggtccggcgagatggccgcaagacggggaagccaatcctcaagctggtcaatcgtcatgatcgaagtgtccacgcggccgggctgacgcaccacggcaccggcgagacgagccagggaacgaatggtcttcgatgtgccgacggcatgcatcgggtgcttcgatttcgggaacgccttgaccatcggctcaagaatcttacggatgttcctgcgcgcgtcttccaaatccctatcattcgcaataccgttttccggtaggaattcacgggtcacacgaccggcacctgccggcacggacagcgctactgtgggatcctcatccgaacccatagccacctcgagagagccaccaccgatatcgatgaccagcagccgaccggcatcccaaccataccagcggcgagctgcaaggaaggtgagtctggcctcatccacaccggacagcaccgtgaccggctggccgacgacgttttcgattcgtttgaggatcctgctgccattcggagcctcacgcaatgcggatgtggccagcacgagcagttgggtaatctcatattctttgaccagccccatggccttttccacagctgcgaccacagcttcgactccggcctttttgattgtgccatcggccttgagatattgcatcaagcgaacagtgcttttcgtgctggcctcaggttccggacgggcgccaggcgccgcatcgacgatgagcatgtgaacggtattggagccaatgtcaagcacgccaagacgagtgacatgcgaatgtaaactaaccatgctttcaagcatagtgacatcgcactccccctttcacctgacattacattgacaacctttgcaaatattcgagtggccatcctattcacctaggatggccacgcaacattcacagcgccgacaacgattgcaaagcgctcacaaacatcatccgtgcagttcggctacgaaatctccgattcgcctcagaccctcacgaagcgcctcacgggaggccgcatacgaaagccgcacatgggtgtcggcagtggcctcgccgaaatcacggcccggcgtcaacgccacgtgcgcttcctttaacgcacgttcgcagaacgtccacgcgtcaagaccggtgccggaaatgttgaagtacgcatagaacgcgccattcggctcaacttccaacggcaaaccgatctcagccaatccgtcgaccacaatgcgacgacgttccagcaactcctgacggcgttcctcgcacacggccaacgtttccggagtgaagcacgcgagtgccgcatgctgggtgggtgtatgcgcgcacaggaagaagttggtggcgagatcgtccatggcttcgagcgcgcattcaggcacgaccatccagcccagtcgccagccggtcatgccgaagaacttggagaagctggaacatacgatggcgtccgggtcgcaggcgagcacggatttcacgtcggagccgtccggttcgcggtcggctaggtcaaggtaggtttcgtcgacgatacgccatgcgccgcgttctttcgccaggtcgcacacggatttcagggtatcgaaggcgatggtggtgccggtcgggttcgacggcgaggtgatcatcaccgctttggtgcgatccgaccagtattcgcggcacagttccggtgtgagatggaatcgggtggccgcgttcgtcggcacgtccacgacttcgccgccgaacgcgcggaccagttcgcgattgcacgggtacgacgggtcggcgatcagcacctcgtcaccctcgttcaccgtcaatgcggcggcaagcagcagtgccgtggaacctccggccgtaatcgcgatacgtttcggatcgacgtccacatggtggcgttccttgtagaaatcggaaatcgcctgacgtaattccggcaagcccattgcagcggtatacggcaatggacggccatcatactgttcgcgcattgcatcacgcactgcgggcggagcgccgaaatccggctcccccaagctcaacttgaccacatcggtgcctgcggcgatcatctcgtcggccatcgcaccaaacaccatggcacggaacggattagcaatctgggcgcggtgcgacatctgcggcagcgcgctgttctcagcatttcccatagttcgtttgtattcttcagacgcgacaaatcgcaagtaccgtcccaccgccgttgcgtatcgtttcgaaaacagaaaatcacatgtcatgtgtaaagctggaaccacgagcatcatgcgccagcggcaagaatcacgcttcgacgatgtcgcaatacagtctctccaaccgttcctcacgcacttttttggcgagctcgcattcccacaccacgatcactttccagcccatcgcttcaagttcggcatgctgtctgacatctcgttcgtggttgcgcagcagtttcgcactccagaattccacattcgatttcggtacgcgtgtggctttcgggcagttttcatgcatatgccagaaacagccgttgatgaacaccatcgtacggtatttcggcaacaccacgtcgggatgccccggataccgcttgtcgtttttgcggaatcgcaggcctttcgaaaaaagaaaactgcgtaccatcatttcgatggatgtgtctttgcctcggatatgcgacatgatgtagcttctcgtgccacgctcatatttctctttttttgcggatttccgaggttttccggtcttcttaacgtgttcctgcgctgccacagcacaccattatggcaaaatccggcaaaatccggcaaatcagaaaagcatccggacgaacgcgtgcaagtgcgagacggaccaacgcgcgttgcgatcatgcatggcgtacgctgggacttgcaacgcagcaataataaatataaatgaatcaacactattcatgcagtttacgaaagatggggtttgatatggctcgtattcatgtcgcgattctcggcgcaggccggattgcacaacatatggctgacacgttggtgaaaatggccgcggatagccgttatgcggatttggttgaaccgtatgctgtcgccgcacgagatgcggtgcgtgcggctgatttcgccgcgaaatacggttttccggtttcatacggttcatatgaggaacttgtggccgatccgaacgtggacttggtgtacatcgctacgccgcacaatctgcatgcggaacaggcgatactgtgcatgaaggccggcaagggtgtgctggtggagaaagcgttcggcgcgaatgcggcacagacccgtgagatgttagccgttgcaaaagaaaccggcatgctgtgcgcggaagcgatttggacgcgatacatgccgtcccgcgccattatcgataagattctcgcctccggtgcgattggtgaaatacaggcgatcgatgcgaacctgtgttaccccaccaccgcgaaggcgcgaatcactgatcccgcgcttgccggtggcgcattgttggatgttggcgtatatccgatcaatttcatcgacatgatcatgcataatgcgccgatcgctcgcattgaatcgtcgatgcgagcgtacgaaaccggcgtggatgcgcataattccatgacgttctattacgagaacggtgtgatggcgaccgcgcaaagttcgattctgtgccatagcgaccgcacgggatccgtgtggggaaccgatggttatatggtgtgccagaacattaataatgttgaggcgattgacgtgtatgacggcaatcatacggttgttgcacattacgatgttcccgcccagctcaccggctacgaatacgaggtggcggccgccgcacaggccgtaatcgacggtcgcaccgaatgcgaggaaatgccccacgcagacaccctgcgcatcatggaactcatggactccctgcgccgcgactggaacctcacctaccccttcgaacgttaagctccaatattagtttcagcgtcggcgaattgcgattccgttcacacagccgacgctgaagcattcattggcagcacatataatttctccttgcactggttgaggaggaacattatgggattgctgagcaagttcatgaacgcgcttattggagaaccgcccgtctccaaaacggcgactcagcccgggcccaagcttgcgcggcaaaacgttcccaatcccacgcaacagcagacgacgcaacgcaagtccactgtacaatcacgtcaaacgcaacagcttacgcaaccatcccaatcatcacagttggcgcgatcgtcataccgcgcgcaaacacaaaccacagctcgcaatacttctgtcacaacgaatcgttcgcgagcgcaatctcatgccaattcacaaccggctcagaagcttatgccgcaaccaatgctccctgccgagcagatcgaacgggcgcgaaatatcatcggcaaaatcgaaaagcatgagttaagcgacgagcagatcagcgccatcgccggagctggtcacaatacgctagtgctcgcaggtgcgggaaccggcaaaaccactaccatcgtcggctatatcgcatggctgctgaacacaggaaccgccactcccgaagagattctggtgctatcgttcaccaaagcttccgccgacgaaatgtcgagccgcatcacgcaaagcaccggcaaagtcattcgcgcatgcacattccatagtctcggactggaaatctgccgttcctccaccattgccaatcgtccaattattgacgggcacacgtcaaacaatgtggtgcgtaacgcatttgaatacctgcttgaacacaatgtttcctatcgtcttctggcatttaaactcatgtcgcaacagttgctcgataaatattccacagctgcacgacttgagaatttccagcttccaacagacgattatgcattcaatcaatatcgtcagaatcttatcgataccacacaaaccattatccagcatatgcggtcaaacaatattgacactactggaatgcaagctcttaacgaacgttatggcggtaaaaacatcggtcgtaatcgtgagatgctgcagcttatagaaccgctttatcacgcctatgtgcagaatttcgcaaccaataatggtattgattttccgggaatgatcgttgatgccatcagttgcgtcaataatggctcgtaccgtcatccatataaatatgtgctgattgacgaatatcaggacatgtcacgaccgcgttatgagctaatccgtgcgcttcgcttgcaacatgatttctcactattctgcgttggcgacgattggcagtcgatttatcgttttgcaggcagtgaccttcatctcattctcgatttcgaccgaatttggcacgcctggggtccgacccgcatgttccagatcaccaccacacggcgcttccgtcaaagccttattgacgcaagcggagcattcgtgatgcgcgataccaatctgtatgtcaaacatctcaataatcccagcgataagaaggattattcgttgaaagcacttggcgggcatactgaggaagaacgattcaatgtgatcgtcgagcaattgcgcaaactaccgaaaaccgcgtccgtactactgctgggccggtatcgcagcgatatcaatctcatgattcgttgcgatcaaagcggtctgttctccatcgaccaaagcactggaaatattcgttttctcgaaaaaccggatatggatattcgtttcatgaccgctcatgcttccaaaggattgcaacgcgacttcgtatttctgctctgctgttccggcggattgaaaggctttccaagcacgattcccgaagagccgctgcttggtctgctactgccggaagtggaacgatgcccgcatgcggaggaacggcgactgttttacgtggcgatgacccgatgcaagaagaaactgttcttcatcgtggatcagacccgcccgtcgcgattcatgtatgaactgcatagcaagatctgcccgaacattttccgaggagtcaaacttcctccgcaatgcccgaattgcggcgaagccctaagcttgcggcacaatcgcaacgatccgaaccgctcattctacgggtgcaccggcttcccaaactgccgctacacccaacaagcaaaataagcgtggcatacgtgatgtgaaagttttttgcttccaaagatcatttccagctcttcgtcaatgtctgcatgccctatactgctattttgtttcaatcttttgggcctggcgcgatcgcccccgttgtatcctggatctgattttccgacaagagaggaagccacgatgccacgtaagatcatcaatgttgtgggcgcggccattatcaaagatggcgaagtattgtgcgcacgccgtggcgaaggcaagtcgctggctggatattgggagtttcccggaggcaaaatcgaacttcacgaaagcgcttcgttgcaccgatgatgagcttggattattttccggaacgagtaaagagcatgatcgtaaatatgtgtttgccactgtgcaaaccatgtctcgtccggaaattcttgcacaattcagcaaagatgatttcgattatattttgatcgacgaagttcaccatgccgccgcggattcatataagagaattatcgattatttcactcctgatttcatgcttggcatgacggcaacgccggaacgtactgatggtgcgaatatttgtgacgtgctcccgccacctgaccgcttcgcggtctgaggggggcttcctgctcaaggctcctagcggagtcagtgtctacaggctattcccgtgcgccccacggttctcgtaagttttttgttatcattcctgcacgagtcgtcgtgtttcgtgcatgatgttggtcgcggcgttcacgtccctgtcatgccagaccccgcaatcggggcatgtccattcgcggatatacaggttcttcgtatccttattgcggtagccgcaatcggagcatagttgactggacgggtagaacctgtctaccgtgaccagctgcttgccttgtcgttcgagcttgtatgcgagcatggtgcggaacatgccgtacccgttgtccatcgtgcttttgccgagtgcgagggattggctcatgtccttcatgtccaagtcctccacgccgacgcaatcatatcgggcggcgagccggttggccgtcttgtgcaggaagtcggctcgctggttcctgaccttggcggcgagcttggcgatgcgccgcttctgtttcacccaattaccggaccccttgaccatgtggctgagtctgcgttgctcgcgcatcagccgtggctccatctgccggtagaaacgcgggtagtcggcttgttcgccgtcgctggacacgtacaggccgtgggaggcgtaatccaatccgacgatatgcacgggtcggacgggttcgggtgcttgggtctcgtactcgaacagtatcgtcgccgtgtatccaccgctcttgagatgttccaccgtggcgcttttgagcttccagtcatcgggaatcgtcttgtgctggcgggcgcgcatcacgcccactttgggaagtttgaggtatctgcctccttcgatgagtcggatgttgcggttgttgttgttcgtcgtgtaccgccatgcgccgcgatgcttcgccttgtatttcgggaagcccacatgcttggggtcgcggaagaaattgttgtacgccttcgccacgttcaattgggcgttgcatagtgcgagactgtccacttcgcgtaggaacggatactcgtccttgtactgggcgggcgtggggttgcatgacttgccggtgcgattgtacgtgtcgatgcgggtttcgagcatgagattgtagacgagtcgcgcgcaccctatcgtccggtcgatgagaccggcctgggccttgtccgggtagatgcggtacgtgaccgcgcaatgccgtgtgacctgcatgacgcgcctcctacctgcgtccctgattctcgatgtagcgtcgtaccacttcgatgggagcgccgcccgtggtcagcaggcagaagctgcggctccagaaatactccttccacagtttctgccgaatctgcggaaactcctgcttgagcagacgactcgacgcgctcttgtaagcgttgatgaacttgctcaactcactcttcggctgggcgcggaacaatacatgcacgtggtccatgtcgtggttccattcctccacggttatcccatacttgggtgcgatgtactcgaatatctcacgcgcacgcgccgaaacgatatcgtcgaacaccttgcgacggtatttcacgacgagcacgagatgataatgcaacaggaacaccgaatgatgattcgactccaattccattgtcacctcctcgattacaacatgtacgactgaacatcattataacatgcgaacgcacgccaattcatctcccgcctacgctccgcttagagacgggagaatccttggcgaaatcagttgaattatttggcaataacgtcgcgtatgagattcgcttgcagcaggcgcttgaagaggatatgctctgcccgtcccactattacggggttggcgaatacattagcaagtttatggggcagcaggtttccgctgattccatgacagacaaggatcgcactgagttttcccgttggctcgaacagctcaccgaccctaatcgcgtgcgctatatcatcgacaaaatccagatttacagcgaagccggaaccgatgtgcgcggtttggtgttctgctctcgccgtgatgaggcgaaacgtctgtccgccatgttcaacgagcaggtgaatcagcagatggaacgaccgtatcgcacgaaagccattaccggcgaaaactcgcaagccgaacgtgacgaagctgtcaaacagctgaaaatggcgaacttgactatatcttcaccgttgatttattcaatgaaggtgtggatattcctcatatcaaccaaattgttatgcttcgtcaaacgcagtcgagcattattttcacacagcagctcggccgaggtttacgtaaggcaagcggtaaagattcggttgtagtgattgattttattggcaattacgccaataattatttgattccgatcgcattgtatggcaatactggcgatcgtgatgtggcccgtaagaatcttcaacgcgagtccatcggcatttcttcgatcagtttcgataaaatcgcctgcgagcgcgtgctcgcttcactcgataccgctgatttgtcggatatgaagctgctgagcaagcagtatcagcagatgcgctatgagttgggtcgtattccgatgctgatggatttcgcgcatcgcgatgcgtctttagtgttcacgttggcttcgaagaataacgattatctgtcgttcgtgatctctcgtgagaagagtctgtcgcgcggcaagcatgcgtcggcttcgtatgtggagcagcttgaaccggtgtcaaacgcgcagtctggtgtgctgaaaatgttgactgcgactcagttgcgtggtttgcgcccgcatgagtcgctgattcttgcggtgttgtgcgatttggattggcgtcgcatcaatccggattgttccgacgatgatgcgtcactgtttgaacgtttttccacacagcacagcttgagtttgtttgatttgcaaacattattgtctacgctgtttccgtatgtcgataataatattcagcagtgcggttctgctttttccacgttgaattattcgtatttcacaagtgcgaatcgcactcgtttcggcaatacttctttggtttgtatgtgcgacaatgaatcgtatgcattgacccaggaatgcgagtcaatgctgcatcacgcaacattccgaacgttctttacagataccatcgaagccagcttgttcaatgcgcttgcactgtcaggggaagctcgcaagcgtcgcatcatgccggatcatgggttcatatatggcgagaaatatagtcttgccgatgtcatgcgattgtgcgcgtggaaggatgagcagattccgcagaatgtgggcggatataagcttgacaccgacacgaattctttgccgatcttcattaaatatgaggcaagccagtatggcgatcgtttcttgaatcctggagaaattgaatggttcagcaaaaacaatcgttctttgcaatctccggaattcaaatggctgcttgatggaaccgagcatacgtcggaatggaaaaaccgtcattttgttcccatttttattcgacgtaaggccgaggaaaaggagaaatcctactattatgtcggttcggcagtagctgtagacgatgcgcatgagtcagtgaatatcgcagatgacggaacccaatcaaaggtcgtgatttccacactgaaactcgcgaaaccggttgaccccgaactctaccgtcacctcaccggcaacccagcattctagttccagaaaattgctgacgtggcggaaagtcattgttgaaccgacggccgccacgcctcagacatggaaaatgtcacctcatctgcaaaaagtgacacagtgcatcgtcgatgatcgctcaagccttttcaaaccaccttttcacacgtgcaatccaccctacaatcatatgcagatgttcgtttgaacagaaaagtaacatgtttttgcagaacaaaaagaacacgctcaatgttactttttacaatgtcattttcaagacctgcaatcattgcaacatcaacgattctcagcatcatcaattgcaaaaacagtattttccgcggtatcacagctaaaaaagcgtgctatcgttagtcacggatacagcaagcatccatcaacaacatgaaccagacttcaagaaatgatgttcgtttgcttatctaaacgaacattaaaacgaacactactaatgttcatgacattatgcgaacacatcgcaggaaaggaattcatcatggcagatgaaaagaccgtcatcaacgtggatctgaacatgttcggccaggacgcggacgccaagaccgccgcagccaacgaggttgccaagagcctcggcatcagcgacgaagccctcgctcaggtggaggaattcaaggcagccctcaccgcgcataacgcttgggacctgccgttcatgggctacgtgaacgaagacggttacggctacgcctatgtgccggacgcagccatcaccatgaacccgtattgggatgcgcacaaggaattcatgaacctgccggaagacgtgcagaccgctttcgccatccgtatgctgttcacccaccgccctgtcgaccgctacggcgccgacatgttcctgcactaccaccgcggcttccaggtcaacttcgtcggcagcggcgccaacaagtactgaccgccccagaggacgttgtatgagcgccccataggacatataacgattcccataccgccgcggcggtactctccagaaaaagaaaggcgcttggctcgagccagaaaaaccagctcaagtcaagcgcctttcgtatgcgctgaaacgaaactaccgcgcgtctctaaaaatcgcccatatcaggcgcatcgaatcccatgccaggtccttccggccccggaccgcccggacctccgaggaattcgcgcgctgacatgccattttccttacgggatgagtccacggcctcctgcatcacccggcgaacctcaaaaccatgcaccacgttcttcagtaccacaacaccgttgccggaagactggtcgcgcgtatcaagtaccagcgtgctcaaaccgaacaggcgctgcaggaacgtgcgctccacactaatatccacgatgcggaatagtttgatgagattgaatttctcgttaaggatgccggttttgatgctcatttcctgatcagtgagcatgtacacggtgaacgtgaacggcgtacgacaccaattacgcttgcgctgacgccacagaacattaccgcttgcaaccttcatatcattcccttttccttcgatggaaagccgccctgttgcggcaacactgccattctaccgggcgccgccgtacggccatgccgctcattccaaatcatgtttcacacatcgtttcacacagtatttcggcataatcttttcgctcaatcaaaaagaaatgcaacagcattcaagcgactattcaaaatcatcggcttttcgccgtgaaaagagcaaaaaaacatgcgcgacaacggcagcatgatataggctgaataaggatatgtcttgttccacgaagcacccgtcgtcaacgcggcacatgcaatccatgtttttaaaggaaaggcatgcaatgagcaacgaacacggtaggatcaaccgtctgcaggaagtcgaggatctcaccgagtacatcaacaatggatggctgcattccggcgaatccgacggcccgacgttcctatggaacgacatgatccgcgaggccagtcaggaagatgccgaaaaccgcaataatgtgcccgtagcacagctttccgacgcggacatggtaatcagtatgcccatgcaatggtatttcgattccatcgccgccatggtgcccacagccgaacgcaccgataccggcgtggagattccaagaatcgacatgccaacgttccatcttgattcacaggcgctttccggcgtggacgcggtggtcggcaatgccatcgtaagcacacgttggctggatgctgtcggcaatctcgccaaggcagtggaaatgaccgcgcgattcgttggcaacgtcgcagatcgagacaatgagggcttcgactatttgaaagacctgattcagaccgtgcgcgtgtacatggacgccgtggcatgcaatgccgatcccatgaccggcgaacaggcgctgaatatcatcacgcaagtggcctgcaatgaggattttcgtcttaacgccatgcaaatggttgaactgctttcgtgcggcctgtcgttcgcgcaatgggacgatacgcgcatgttcgcttacgatgcgttgaataagggctttgccacgatgagtgatttcgcctcgtctgcttcgaggttgtcaaactcggcagatgattccgacagccgcgacatgcaaactgattcgcagtctgttgcgcaagtgaaaaccgatttgggtttgtttgaagacgctgattccttatccgcagaagatttgaataatctcgcgatgcttgatcctgctttgctttcagaaaaggagattgcgcaggccgcgcagaatcagttcgatcatgccgtacagtttttgcgacatgacttgctgcggattagtggtgacattgatgaggctgatcgtttcctgcgtgacaatcatacttccgaaccgctcgccgatgcgtatgcggcacgtctgattgctgccgaacgttggcaggatctgctcgattttgtcgatctggtgttgcgggacaaacctaatcaggtcacgatgatgttccccgaagaagtggtgccctacgagtgggagacgattcgtgaggccgctttggaagcgctgggacgcagcgacgaactggttgccatgtatcaggaacgcttggatgatacgtatgatcccaataccgcactcaatcatctgaaactccacgcctggttgaatcagcagtagtcccgattcctccactcactggaacaatcctcccgcccacgggcctcccggcgtccgttttcctccaccgaatggaggaagacacccgtgcgcgggaataaaaaaggaccttccgggaaccccgatggggctcgaccggaaggtccataagttgaatgcggcggcgtgctactctcccacaccctctcgagtgcagtaccatcgccgcgaccaggccttagcttccg

SEQ ID NO: 76 - DNA, 237427 bp, Bifidobacterium pseudocatenulatum
tgatatgagtgatgggaccgggcggcaggcaatggcagcgcaaagtggtacgtcggataatccgaaatcctccaatcaggaatcatcgaaaaagccgaaaacgctcggcaaatatctgttggtgtcggcaacgcaaaccattgtggaattcggatcgttcaccttgctgcatgtgctttccgtaccatccgccatcgcgaacggcgtggccatcgtgctgtcggcttcgtacaacttcctgatgaaccgcaatgtcacgttcaaatcgtccagcaatttcggccgtagcgtggctttgttcatgctgctgtgggtttggaattacctgttcggttcgatcatgctggcatggctgccttccgcattcggatggaatgcggtgttggtgaagttcctgactatggcatgtcagttcgcgtggggctatccgctgtgcaaggaagtgatttttcgctgaacctgcaagcgtgtcaatccgggtggcaccctatgacagcaccctatgtatgattgaatatgtcttgtattaactccagaaagaaatggaaaggcaatgaacgaatcgcaagattccaacgacagtagtacgagcaatccgaacgatattcgccaacaggaggcagaacatcaaggagcggccgtaaaagcggcgctcggagccaacattggtgtggccatcgccaagctcgctgcggcgttctttaccggatcgtccgcgatgctttccgaatcggtgcattccatcgccgactgttccaacgaaatcgtgctcatggcaggcggtcgcttctccaagcataagacggacggcgatcatccgttcggtctgtaccgcgccaaatatctcgcttcgttcgtagtggcgacgctgctgtttttcgtcggtggtttcttctccacttcggaggcggtgaagaaattgttcgccattgccgaagaccccgcactgcgtgacgccaaccagatggaactgctggtggcgtttatcgtggtgtttatcagcgcttgtttggaaggctacggcctgcatcaaagcatcaaggaagcgaacgagcgtatggagcgcacgggtgtggcccatatgggtgtgttccgtttttggaggcgtaccaagtcggcggagcttgcgtccgtcattatggaagacacgcttgctttgatcggcttggcattcgcaggggctggcatcggtcttgcgattctgtttgataatgagatatttgatgcattcggcggtttgatggttggtcttgtattgattgcgggatcgttgctgctcatgttcaaatccggttcgctgttgattggtgaggccgtcgattcggatacgcgcaagaagattgagcaggctgttatttcaacgcctggtgtggaacgactgctgaatatgcagaccgtgcatatgtccgaggatgacattctgctgtgcgtcaaggtgcagaccagcaagctcgaccgcgattacgatgttgaaaccgtgaacaaaatcgaacgaagcgtgcgtaccgcgctgccgtggttccgtttcgaaatctacgtagagcccgacctctaccgcgccgaccacaaaatcgtctcgtagtggtgtgcggtgtacctatggttatgagacgtagagtatgaggcgacgatacggttttcaggaggagctggcattccgatgagttcggagtgccagctcctccttttcatgtgctttcttgttatgcgtctccttgagcccatacatatgcatcctttccaacatccgagctttagcctcatcaacctcggcgcgagtaatgccgctatccagtatgaactgctcaatgctatagctcattacatttcctttcgtatgattcctctaatctaatggattacccccatatctaatagatcgtaaaacccgttttcttgaagcaaaggcgtctaggtggaggtatgtctcggatgcgattggtttgtttatctcgagatgcgagacacacttacccccccctaaagtggtagggtgggtggtgcattcggggacgcatgcgcccctgtcataacgctccgggagacaggatggagaaaatggagaatatggagaatccgaagaaactggccgttgcgaccatcgcaggcttgaccgaggtggccggtatggccgcgcccgccatggcagatgagacggccgccgatccgacggtgggccagacccagtcggccgatccgacgaaggatgcgctcgacaaggccaacacggccgtatccgaatcccagaccgcttatgataatgcccagcagaatgtgcaggacgctcaatccaaggtggatgatgcgtatgcttccgacccggccacgaatgcggcgcagtccgaactggatgccgcccagtcggctaagaaggatgccgaccagtcggcggctgacgcgcaggccgatgtggatgccgcccaggctgctctggctgaagtgaacgccacgctgaagacagccgaaaccgcattggccacggcgaagtccgacgcggaatccgcgcaggacgcgtacgacaaggcccacaaggttgtcaccccgtcgaaggatacgaccatcacggttgatactccggacagtgcgaacagtgcgaacagggcggccgtgaagacctccacgcaggccaagcttggcgacacgggcgtggacgtgatggagaccgccgtgtttaccattatggccgccggtaccgccggagccacgctcatgctgaagcgtcgtggtgacggccgttacggtcttatggcacgccacgccaagtaggtttttgccataaaatcctagaaaatgatgtgcggatgggaacgaacgattcccatccgctttttcctaaaacgtatgtgacataactcatcgaaagcacaagtatgcagggaaaactatctgaagtttccaacccgaatataagcgatgccgggtcaaagaatgtaactgaaaacaagaagaagagcagaaagcctgctgtgatcgccgtggcttcggtcgcggccgtggctgtgccggctggtggcggctggttcgtttggaagacctacgcgaaccatgagctggccgaggcgagacaggcgtgtgtggaagcgtcggaaagctaccgcaaggcggcggactcgtattccgggctggtggatggcgacgcggccacagcctcccagatcaccgtgaagcaggtggcggatgcgaagaccgtggatgcgttggccgaagcgttgaaggcgaacgagcctgacgtggtcgcctgcgtggccgattcgaaggcggattacgagtcgaagaacagcctgattgaaaagaacaccggctggtacgggaaacacgagaagagcttggaaaacgcggtcagggccgtgaacgattcgaaactggagaagaccgtttccgatgcggaacggttgttgaaggattcggacggcaaggtcgccgatgcggcgacgcgcgacgaactgtccaaggcagtcaaggccagggatgcggacaagatcgcggccgcgtcgaagaaggtcaacgactcggtgacggcgaagacgaaggcggacgaggaggcgcagcgcaaggccgaggaggaggccgccgcgcaggccgccgcacaggcccagacgcagcagtcgtattcggcgccgcaacagtcgtacacgccctcgtattcaggcggcacgtcgggttcgaccagcggtggttccagcagcagcgcgcccgacttcgttccaagcagcggagggtacggcgtagagccggatggcagctggcatccagggaacattattcagcactgattcagacgactcttcttctcaagggacccttcggggtccctttttcgtatccgcagccttccgggaaaatgtccaacccgacacgcccgaaaccgggttgcatagcaggtggatgacggaaacgaatccgatatcgacgtttgtcgacggctgggcatgtgaagtgttcggacgggatttgttctcctgtccgaccccaccgggagtggggtgaacatctgcagatggatctctgaaaggagacggaacattgggttccaagaacagtaacggaaggcgaaagacgctggccctgctcgccgccacggcgacgttggccggcggtctgaccgcgggcaccgcctacgccggtggcggcggcggagatcagggaggcacgggcggtggcggttcgtccgcgcagttctgggcctacaaggacgacgcgacggggtcgtggggttccgcgacggacctgaacagcgtgagccgcgccatggccgcgcggggcgtgcgcatggacgattcggccggcaaggccgccaaggcgttgagcgacgcgaacgcggaatgcgtggccggcttccgccagaggcatccgggcgagggcgacggcgattgccgcgtcgtggccgtgggcgcggcgtccggcaacgggtccaccaccagcgtgtggaacgggtccggcgtctacgacgcgaagatatggaaggacaactggtacaagtacgtcgcaccgaacacttacaactacgctggatctcagtcttatcacaccggcgatggcttcagcgacgatccatcgaacagcgtcgacaagatcatggaacgccacgtcgactcgacccgcagcatcgtcgtgatcgtgctcgacaaataccagcccgccccgccgaactacacgctgagcgtggccacgaaggcatccggcacgaccaccaaggctggcgacacgcagaacgtggcggacacggtcaccaccagccgtaacggcagctcgatcagcgagaacgtgaccggcaccagcacgctccgctgggccggcgtggacggcaccacccacaacacatggaacggtgataccgaagtcaccgccgaaggctactactacgcatccgaggacgaaaccatcctccagcccgtcgcacgcaaagacggcgaaaccgtcgaccagatcaccagcacgctgaggtgactgtgaacgtcccgaatcttccagctactggaagattcttcccgctgacgagcacatgagcgcaccaaattctccagtgggtggaggaatctgcccattaacggttacgatcgcatggtcggcacatgcgagaagaatcagtggcatgactgaagccgcacatgatgattatcagttgcccgaagaattcgaacactgttcgaaacttgcccctgtacgcgatgcgcctagcgcgttggaccgtgtcaagcaggtcgtacgcattctgcacgaaccaggcggatgcccttgggacggcgagcagaccaatacaagcctgcttaaaccactgttggaagaaacctacgaatacatcgacgccgtggaaacgaacgatcgcgacaacatgcgtgaagaactcggcgacatgctgctgcaatccgttttccaagcgcaagtatgcgccgtggatgcgcaggatccattcaatatcgacgaagtgtgcaatcgtctcgtcgacaagctcatcacccgacatccgcacgtcttccaatcagacgacgctaccgacgcttccgcgccagcaccggaaaatgcgcaagatacgttgaaactgtgggaagcgatgaaacagaaagaaaagcatcgcaagtccatgctcgaaggcatctcccacgcgcaaggcgcattgccgcgcgccacgaaaatcgtatcgagagtacacaaatcgcagtattgcgatcagcttgaaacagcattcacaacaagcgcaagtcaaatggacgaacagcatgatggcgatcatccttacgctgacgaaatcatcgccatcatccgcaaagcgcaacgtgacggcgtagacgtggaatccgacctgcgttgccgcctgcgcgacatagaatccgaaatcgaacatatcgaaaggaccatgaaccatgagtgacgtcaaagcactcgaccctgcgctgctcaaacagtattccacagacttcaacgctgaccgcgccaatctggtggcagccaacgcggcagtatcatccggtgtgctcgccgcagccaccgactataagggcgagcgcgtgctgcagaatgatttctccatcgagctgaagcaggggagtatcaccaatcagcgtagttcggggcgttgttggatgtttgcggcgcttaatacgttgcgttatgagttgatgcatcgttggaatttggaggatttcgagttttcggaaacctacctgtttttctgggatacgatggagaagtcgaacacgtatttggagaatgtgcttgccacgttggatgagccgttggatagtcgtgtgttcgaggcgattaattatggtccggccgatgatggtggttggtggcagatgttcgctgatttggtgaacaagtatggtttggtgccgaagagtgcttatccggagtcggctaattcgaagagttcggatgcgttcaagcagtatttgaatacgaagctacgtgagttcgcgtccgatttgcgtgaccgtcatgcggctggaacgtcgttggatgagttgcgtgcgttgaagaatgcggatatggctacggtgtatcgcatgtgtgcgattgcattgggtgagcctccggagcgttttgattttcttgcgcgtacgagcgatgacaaggatgacggcaagaagaaaaccacgggggaggggccgtctgaaaaggctgcgaaaaccggtaaggatgagcgtccgcagattcgtgaattcggtatcactccgatggagttttataagaagtacgtgccggtggatgtgaacgatctggtcacgttatgcaatgtgccgatggagagtcgtccgtttggcaagcggtatcgtattcgtttttccgccaatgtggcggaagcgggtgatatggagtttgtgaacgtgcctcttgacgtgttcaagaaggctgctgtggaccagatcagtggtggtcatccgatttggttcgcttgtgattgcatgcagttctcgttgcgtggcgatggctattttgattgcgataccgtgcgcgttgaccagcttttcggtacgaaattcacgttcgacaaggccaagggattggagtatggtgattgcccaagcaatcatgccatgacgttgactggcgtgaatttggatgctgacgggcgtccgaaccgttggaaggtggagaacagttggggcaaggataatggtcaggatggctattatgtggcgtccgatgcttggttcgaccgttatgttaccgaactgatcattcgcaaggagtatctcgatgagaccacacgcgaaatactggccgatcagccggtcgagcttgaaccttgggagccgctcaccaagcgaagccggtgaaggcttgcgcatatcgcgcatgattcggtttgattgcaataaggaatgagataaacagtggagggcgtcgattgacagattcggcgccctccacttattgcagtatttagttattatttaattgctattcggcagtaccaaggcatgcttcgaaggaacggcgggtgaggcgtccacggttgacgacgcccacgagcttgccttgttcaaccaccggcactttcttgtactgttgatagccgaacatctggcagacttgcgcgatattggcatccgattgcacggtgacggccggctttgcggcaataaccatgacgttcatatcaagcagttctgcgtgagacagttccgggaattcgccgcgggccatgccagtgaccagcgtggaaatgtcggaaaccggcgcgttgtcttgtgcgaagcggcacagtacgtcgctatcggagatgaagccgaccacgtggcgttcgtcatcgacgataagcatgccgctgatgttcttttccaacatcatgcgcactgcgtcacgtacctcggcatccgaggctaccgtgtaaacgtcatgctgcatcacatcggcaacggtcttgacatccaaagcgggaacatgctgttgcgcggacttgttccatccggcggcatcgccgatggcgtgaactatcttgccggacaatggtgcgacgatcagcatctgaatcggcaacgcgatggtgaaattgtaggggaacatgcgccagaatcccgtgaacgcgccgaatgtgaaaccgaatgccatgatggcgccgaatacggtcatgaacacggtcatcagcaccaccatgaggaatttgaccgtgatgcctttccataccgcacggtcggttgccgcgcagaatgtattcataatcgcgcgggagcttggcgtgcagatgcacaaatcgcaaatcatgccgaccacgtaggccaacggccagtcgaacaatgcgtagctccacgccgccgcaccgacgtcaccgatacgtacgccgtaattgagtgccgccatcacataaatcatgatcgcggacatgatgaaactgaagagaatgccctccttgccgttacgtggcatggaacttcctttcgctatgcgttcgatgtgttgctgcatcggcccctctggtctgttccgcacgtcatgttccaacaggagcgcggaaggctagggggcgcataacgaaatccgaaaaggttcggacgatcgcaatggcgacttcctggcaaacgaatcggctcaagccctcaatgggcatgcaagatgcgattcatgagtcggggccgcttgcaaatcacagattgttcgcagaccacaagacaaatacggaaataccgaacgtgctcgaaacgcatgtggaaagaaaaagccggacgttttcgcgtccggcataaatacaatccgaataaaactcgaattactcggcttactcttcggcgaccaattccagataggaatcgttccataggtcttcgtcgccgtcgggcatgagcagcacgcgttccgggttcaatgcctgcaccgcgccctcatcgtgggtgacgagcacaatggcaccctcatacttggcgatagccttgagaatctcatctcgtgaggccggatcaagattgttggtcggttcgtcaagcagcagcacgttcgcacggctcgtcaccaatgtcgccaacgccaagcgggtcttttcgccaccggaaagcacgcgagccggcttcaacgcatcatccccggaaaacaggaacgagccgagaatcgaacgcgcctgcgtatcattcagttccggagccacatgaatgaggttttccaacactgtggcattcaggtcaagcgtgtcatgttcctgcgcgaaatagccgattttacagccgtgaccgtagtccacggaaccggtgtccggctcttccaaatgcgcgagcagacgcagggtggtggtcttaccagcaccgttgtatcccaaaatcaccacacgcgagcccttgtcaatagccagattcacgccggcgaatacaatgttcgaaccatacgctttcgacacatccttcgccatgatcggcgtgcgaccgcacggagccggctccgggaaccggatatccgccactttctcctgcttttgtgcctcggacgtgttctcgagaagtttctccgcacgacgcatcatgttctgcgcggccacggccttggtcgccttcgcatgcaggcggataccctgctgcatgaggcgttccgccttcttctcggccacttcacgttcgcgacggcgacgttcctcatcaaccacgcgctgatgcaggtaggctttccaaccgagggaatacatgtcgatctgtccgagctgcgcatccagatgccataccttgttcaccacttcgtccaacagttcggtggagtgggagatgaccaggaatccaccctcgtatttcttcaggtatccgcgcaaccattcgatggagtcggcgtccaaatggttggtcggttcgtcaaggattagcgtatccgcgtcagagaacaggatgcgggccaattcgatacgacgacgctggccgccggaaagcgtacccaattgctggcccatgacctcctgcggcaggccaaggcttgccgccattgcggtcgcttcggactgagccgcatagccgccggccttttcgaaatcctgcatggccttgtcgtaacggttcatcgctcgggtcatgacgtccggatccggatcggtcatttccttttcagccttgcggatacgactgatgatggaagcgatgtctcgcgcgctcatcatgcggtcgagcgcggtctgttccggatcggcagcatgcgtgtcctgcggcagatagccgagcttgcccgatacacgcactttgccggcggtgggcagcatgtcgccggtgatcacgcgggtgagcgtggtcttgccggcgccgttacgtccgaccagaccgatcttgtcgcccttggcgacgtggaaattcgtgggatgcagcaacgtgcgcgcgccgatctgaatctcaagctcctgcgcttcaattgccatgcctcaacacctctgcactttcgttactgtcgttccaaactggctgtgccgcacataacggcctgcccatcatttcataaggccaaacgccaatcgaacatcataccgaacgcctgtaaccacgtgaatcccaccgcgtggtacgcaatcgcaaatggaatagattgcgcggaagcgtaacaatcagattattctggtgagcaggcaaattcggaagggagcaaacatgaagaaagctttgatcattgtggatgtgcagccgacattttgcgaaggcggcgaactgggtgtagccggtggcaatgccgtcgcggaacgtatcgcggattacgtgaatgcgcatcgcggcgagtacgaatacatcgcaaccacgcaggattggcatatcgagcccggctcacactggtcggagcaacccgactatgtggatacgtggcccgtgcacggcaaggccggcactcccggcgccgaacttcatccagcgatcgccgcgctgcatgtagagcatcatttcaagaagggacagtattcgccgtcatattcggggttcgaaggatacgaggataatacggattcgattccttcccgcgaacaggtcgcctctgacatggctacagggcgtacgcttgccgttgcattggaatccgcgggtatcgaatgcgtcgacgtggttggcttggccgaatcgcactgtgtcaaggaaaccgcgctggacgcccgtaagcttggacttgaagtgcatgtcatcgaaaacctgaccgaaccggtcagtgaagaactcggcatcgcagcccgccagcaaatgctctccgccggcgtcatcctcgactagtttcttgaggaatgggacaacgaatggagaagggattgttcagcaggcgtgtttatgaggtggtgcggcgcattccgaagggtaaagtcgccacctatgggcaggttgcggctttggccggagcgccacgcaacgcgcgttttgtcggctatgccctgcattcgaatcctgagccgggtgtgattccatgtcatcgtgtggtgttccgagacggctcgttggcacccggattcgcgttcggcggtccggaaagacagcggcttctgctcgaagaggaaggcgttgtcttcatctctccgaaaggtatgcccgaactaagcgagtcaggcaagatgaaagactcgaacgccggagcttccggactgcgagtcgatctcgcccgttgtcagtgggacgcctagtcgctttcaatccgtgtcaaccgcttacgcccccaacgacatttgctttatccgccatggttggataatgggtgcctgccataaggcgaagaaagcaacggggacgcaaaggtggaacggcaaggcatgtggcaacaggacgcaccaggggcgatatcggtcggaatgccggttgtatcgttggcaccggctccgcgaaccatggcataacatcggcttaagtcgttggaaaatagcgcgacacgccgcgatttgcggagttggcatgcttcatgtatattttctactcgttgcccaccacggtggaaacaacttgcggacatagcttagttggtaaagcgcaaccttgccaaggttgagaccgcgggttcgagtcccgttgtccgctccattcgaaagcttccggaaggaagctttttcatatccgaccgcaaatccgggcgtcatcctcaattcatcccgaccgaaatccgaactggaatcctcctctgttgagaaaacgtttgaccacaatgtgaacgttctcttgaaaagagataatccatgcgagaggctaggagaagttccgccaaaacaggcaacgatgccgggggagagcggaacggacggaggtaaaacaaatgaacgagaacagcgacattattttcgtgccggacgattccgccagccacgagtggacggaacgggacagcgaactcgtagaggagtatgcggcccagcttatgagcatgagcatctagccggaaattagatggggccgggttccctcttccatgacaggaaaagacgtcgcattcgtactgtaactgcggcgtcttttccttgttttcgtttagaatggagacttgccgccaaggcatcgaacacatggaaaggcgtattgttggctgagatcagacgggagatggaacggcttcgacccgtatacgaaaccggtgtcctacggttgctgctgcgtaacaattccatgctgtacgtcgcgttgttgcgttccacgttcgacccgctgacgggggagctgccgcgcgaaatcgtcgaagaacggttcgcacgcagtctcaaccggctcatcgaaaccgacgattacacgctgaaagacgggcagactgcgcgcgaggccgcgcattcggtcctgcttgacctcgcccgcgaaggggaaggcgactacgcctggctcgccaattccatggatgtggcctcgcaccgctacctgtaccgtctcacagcgcgagcgcaccgtgccatcgaagcgctcgaccggcttgaggacaccacgaaagcgctgtccggcgcgcaggccaacagcatcatcatggaaatcgagcatgctcgcatgcagttgaccgccgatccgcgcgagcgcatccgcctgctgaagagggacattgaggaacggcagaaggaaatcgacgagctggaacatagcgaggccttggaaaagctcacgtccgaacaggtcggcgacatcatcggcgtgattcacaacactctgcgaggagtgcccatcgacctgcgcgagctcgccctttccgaacgggacaacggcgacgcgctccgacggcgcatgcaggccggcgccatgagcgtggaaagcatcctcaccgcataccatgacgaataccgacgtgcgttccgcgaatccgacagcggacgtcgtttcgaagacgcgttccaagtcatcgtcaccgacgaaggccggcgcgagatcgacgacgcggtgcgggacatcgccagaaacccctatttggatggcgagccgagcgtgctgctcaaccaggtgcgttccgaactcaaacgcatctatgaaggcatcgaggacgtgcgccggcagatccgcacgtccgacgaggcggtcagccgtctcgtacgccagcagaccgacacgagctaccggaccatgctcgccaaactcaaccagctgttcgcaaagaccagcgccgaagccaaagcccatcccaatgaccaaagccggccctaccatacggacgccgggcaggcgaaattcccgacattgccatctcgtccggccagatcaatggcgcgcgccgcatcatccagcctgaacgacgccccagcggcgaccatcgaagcgccggacctcaagaacatggtcgaaatatgcgggccgcggctgacgcgcatgatcaggcttatccgcagcaatccggtgacgacatcggacggcatgttcgtggacctcgcggcaagcttcaaccagctgccgaaagccgaacggagggaaagcgaactggtcggcttcctcagcgccctgcgcacgcaggacgactcgtcatacgtgacatggcgctgcatatcgatcgacggcagcgaacgcgtatggcgcaccaaacccattctcaccaccgaaacgacgctcgacgacatcatcgaggagagataagcatgacggactatatcgaagccaacatcgaggaaacgatcctgacagaaggggagccggtattggaagaggccggcagccagcaggcctcgaccgcgctgttcaacggcgacaccggcgacatgcccgtcgaagcgcgcatggccgcgatcgcgctcaaacgcgaacgctacatcgacggcagcctgtatgacctcgcctgcgagaaccgtgaggtcgtggaacgttcgctcaacaacgacatgctcagactggtcgacaacacgaaataccgcatcatgtacgcgtcgccggtcaccgactcggagacatgcatccgttcgttgaaaacacgtatgagcctcacccgcgaggaggccgccacgcttgccgcgctacgcatcaaagcgttggaatacgaaaaccagaacgccgaaccatgcgactggcttatcagcttcgacgacatccgcgcattgctcgccaccggcgcgggattcctcaccgccagcaacgacgaggaaggcactgcgaagaaaatcacgtccatcatctcacgcatgcgcacctacgggtatctcgcgccgatcgaagacgacgacatgtacgtcctcacgccactggtgcccatggtgctcgaccgcggcctcgccgaccagtggctcggatccgaaaccacggacgagaacgcatccgccgacggccgcaccaacgccggcccggacgacaggcccatggaagacatagaacaagacgcattcgatttcaacaccgacgacaaccgtttcgacgaggaggaacactgatggcagacgacatgaagatcgtttccgacaagtggatgctacaaagccgacaaatcgtcaactggggctcatacggcggctggcacgaattccgcccatccatggacgaaaccatgccggtgaccctgctcgccggcgccagcgaatcaggcaaatccacactcgtcgacgcgcaaatctcactcctctacccatccggaaccccctacaacaaggcgtcgaactccggacgttcggaacgcaacgactacacctacctgcgtggcatgatcggcgtaagcgatagcgaaaacggcgaaacgccgatcttcctgcgcggcaaagacgccgacggcaccccacagaacatctggggcgcaatcgtcgacacctacgtgaacaaaaccgacggaggactgctctcctgcggcaaattcctctacctgaacgccggagacggacaagacggactacgccgccgctacatcacctggaaccgaaccatcgacccacgactcatggaccagtaccgcaacacaccattcacccggtccatgttcgaaaaaacctatccggaatgcaccacgcacaccaacgccgcggcattccacgcctccatctggcaggacatgggcctaagcgccgacgcctgccgcctcctgcacaaaatacaatcggcggacgccccctcaaaactcgacgacatcttcaagcaaggcgtgctcgacatacccgaatccatccgcctcgcccacgaaaccgtcgacgactacaaccggttcaacgaaaacttccacagcatggaagacaaaatggcccgcgtcgccatcctgcaaaacatccagacacgctacggcgaatacgcaaagcaaaccagcgaacgacgcgaatacgaacccatcaaccccgacagcgaacatggcaacgcaacactgtccgcatgggcgcgctcgcgcatggccagcgaagtgcgcgctggtctgccggccgcgcagcgcaaggtcaaggagtcgcaggaggccatcgatcgggcgatgcagcgcgtcggcgagctcaacacgcgaatcgacgccgtcaaggaacgtatccaaggcatcgacggcggcagtctgcagcagctcggcaaggatcttcaacgcgtgcgccaggacatcgacgaggcgagcaggcaacgtcatgccatagccgaacgattcgaacaggtcgaaggcaggcttcccgacagcgagcagacatgggacgccaaacgcgccatgctcgccgaaacgctcgacacatacgaggaacggttgaaggacgcgaacgccagattccagcagctggtaggggagcgtcacgaccgccagcgcgaccgtgacagcctacgacgggactatcagcgcaaactcacgcacaggacgcgcatcagcgatgacatggacgacgcgcgcacgcttatcatgcgggcgaccggattggacgcgtccgaactgccgtatgtggccgaactgatggacgtgaacgaacagaacgaacagtggcgcctggcaatgaacgtcacctacgcgcccatcgcgcagaccatcctcgtcgacaaacgccacgagcaaggattcgcggcgaaaatcagcgccatcgacccgaaactcatgacacgacgcacgtggcggttcatcgacaccggcatgcaatacgaatcctccgccagcgaaggctggatgtcgtcgaaactgcaataccgggaggactctccgttcgccggatggctgaaaaaccagacgacgtcaccacggttcgacgcgcgttgcgttcatgccatcgacgacatgaaccatgacgaacgacaggtgcaggccgacggtcagatcaaatccggcgaccgtggattccacggcagcaaaggactacaccaggtcatcggcttcatgaacgaacaatacctggccgaactgaaaaaccaactcgacaaggccgaacaggcgttgcagaacgccgaccgtcgaagcgaacaaatgtccaacgccatcagcctgctgcaagacgagcacgagctcgcacgaatcatagccgacatgccatggaacaaaatcgacgtgaacggactacgggaacaggaaacacgaatccgcaagcagatcgaacgcatcgaaagcaacccggaactcagccaactgcaaaccgaactgaaacagctcaaccaacaagccaccgccgaaaacaaaaaccagtatcaagccgaaaacgaccttaacaacgcccaactcgccgtccaagccgaacaagcatggctcgacacccacggcaacgacgacttcgacgactccacactatccagcatggtatcgaacctgctcgccgacgcatacgacaactgcttcggcgcatccgtgcgcacgcaagaccggccaaaactcatcgcaggcctctacgaccatgacaacgaaacaccattccacacgcgtgcactacgcaacatcgcacgcatcgcacgcacacgaatccaagaaatcaacgccagagccaaccaactgcgcgccgacacggaacgcatcatggacgactacctcaacaaccactccacagacgacaacaccgtcatggcaagcgtggaagactaccaatacttcctcgacgaactcgacgaactcaacatgctcgtcacccgcgccgcaaccgacgaagaatacgccaacagcgtcaaaaaactctacatgagcttccaacaactcaaccgcgcgctacgcaccgacgaagaaaacatcaaagaacagctcaaccgcatcaacagcatgctcaaagagcaacaattcggcccacaaggcggcagactatcactcgacgtgaccttcagccccaccgaccgacaattcgaaacaaccctcagccgcatcctgtcaaaactcgaagactggacacgcaacgcaaccaacaaccccacagaaacacgcaaagcattcaacaactgcgaaacattcgtgaacagactgcacaacgaactcgacaaaatacacgacaccaacagcatcaaagcatacggcgcacgcaacctcgacccacgcgtacgcagctcattctacgcaatcgtgcaccacgacaacgcccccgacgaacgcatcagctccaccggcggaaaatccggtggagccctacaagaactcacctcattcgtctacggcgcagccctcatctacctcctcggcggcgacctcaccgcacaccccacctacaccacgctcttcctcgacgaagcactcatcaaagccgacggccgctacaccaaacgcgcgctcgccgtactaccccgactcggcttccaaatcatcgtctccgccccggaaagcaaaaccgcggaaatcctcaacgtcgccaacagagcatacgtcgcatacaaagacccatccaccggcaactcatacctacaggaactcgacagcgaaaccatcacacaggacgaaacacagcccaccaccgcacccgcgaaaccaacaacggaggcataacccatggcaacggccagaagcaccaccaacagcgacatccacagccaactcaacggatacgtcaccgactatctcaccaagcacatgtatgacgccaacacctcctggccattgcgcaaaaccatccgactacccaaacaagccgaactcgaagcccattacacgcacatccgtgcccaagacgaagccatccgcaactgggcacaacaacaccactgcgaaaccagcgaaaaaaccaaaatcatctccaacggaatcgtccgacaaaccagccaactcatcgactcggtaaccatacccgacctcaacacggccctcaacatcaccacaccacaaacacgcaaactctaccaacgcgaacaccaacgcgcacgcaccatcaccaaccaattcaacctcgactccaacacctccataaacatcgccaaaatcctcaaaaaccacgacgataccgacttcaacctcgtcatacaagccgcacactacttcgccaaccacaataccgaaaacatgaccccacgcatggtccccatccccggattcagcgcaaaatggctaggcaaaacaacatcaaaccgctgcaaagcaatctgcaaactcctcaaacgagaacaactagccctcaacgaccgccacggagaaatccgactccgactcctcgacacacaacaccacaaccaaccagacctcatcgtgacacaaccatggacagacggcgcgccacacgacatcacccacatcatcatcgtggaaaacaaagacacctaccaagccatacccacaacagaacacgccatctgcatattcggcagcggacacgcggcaacccgaatcaaaacactactaccttggatcacaaccacaccccacatcatctactggggagacatagacgcagacggcctcgaaatactctccgaactacgacaaaccggcatcacctgcgactccatactcatggacagcacagcatacaaaacatacgaaccatacggcaccaaactcgacaccaaaaaacaacccctcaaaacacgcgaccccaaaccaacaccaggactcacgcaacacgaaagaaacttatacgaacaactctgcaccgggaaaaacacaacctacctacgaatcgaacaagaacgcatccccatcaacgacgcaatgacaatactccacaaccaacaccaatggaacacaacacaccacaaatagaacacctgttcgaaatcataacgaaaatgaggtatcctaaacaactagaacaaagaacaaccaccagcggaggcaagccgtggcaaccaaacgcaacaacgcagcaaacggcgacgtcatagtcgaacgcgttctcaccagcgacgcattcctcgcaagagaaatcaaaaaagcccctctcaaaacgaaaaacggttcacttacagccgacctcaaacacctgcccaacgacctcaaaatcaccatccaaggcgctcgcgagcataatctgaagaacgtggatcttgagtttccgcgcaatcgcatggtggtgttcaccggactgtcgggttctggcaaatcctcgctcgccttcgatacgttattcgccgaaggccaacgcagatatgtggagtcgctgtcggcgtacgcaaggcagttcctggggcaaatggacaagcccgacgtcgatttcatcgaaggtttgagccctgcggtgtcgatcgatcagaagaccacgaaccgcaatccacgttcgactgtcggcacgattaccgagatttacgattatctgagattgctgtttgcccgcactggcattccgcattgcccggaatgcggcgcgttggtcagcgcacagacgccgcaacagatggtggacgcgttgctgcagtatccggagcgcacacgattccagattctcgcgccggtcgtccgtgggcgtaagggcgagttcgaggatctgcttgaactcttgcggggcgacggctacgcacgagcgctgattgacggcgaaatgaagcagctgtccgacgacatcaaactcaccaagcagaaaaagcacaccatcgaagtggtggtggatcgactggtggtcaaggacggcatccgtcagcgtctgaccgattccattgaaaccgcattgaagctcgccaagggtatcgtggtggccgattttgtggatttggatgagaaggatcctgaccgccgtaagcctttttccgaaaaacgcgcatgcccgaacgggcatcagcttgaacttgatgagattgagccgcgcacgttctcgttcaacgccccgtacggtgcctgcccggtatgcacgggcatcggatacaagctggagattgatccggaactggtgattcccgatcccagcaagacactgaatgagaacgccatcgaaccgtggggcatgaccaaaggcaccggcgaatattatcgccatgtgcttgaggggctcggcgatgagatgggtttcgatctcgacaccccttggaaggatcttccggaagaggcccgtcaagccattatgtatgggcgtgatttcaaggtgcaggtctcgtatcgtaaccgttggggtcgtatgcgcgaatattccaccggtttcgaaggcgtggtgcgtacgctgatgcgtaggcatgacgagaccgactccgatcagatgaagcagtattacgaatcgtatatgcgtgaagtaccttgtcaggcatgccaaggccgtaggcttcgtccggaagtgctggcggtgaccgttggcggggaatccattgccgatgtgtgcgacatgtccgctgagacaagcctcgcatggatggacggcttgcagcttgaagggtcggccgcgcagatcgccggcgaggtgttgaaggagattcgtgcccgtcttggattcctcaacgacgtcggactgaactatctgacactgtctcgtgccgccaaaaccttgtctggcggcgaggcgcaacgtattcgtttggcgacccagatcggttccggtttggtgggcgtgatgtatgtgctcgacgaaccatccatcggcttgcaccagcgtgacaatgagcggctgatcaccactctgcatcatctgcgcgatcttggcaacacgctgatcgttgtggagcatgacgaagacactatcaagaacgctgattgggttattgacatcggacctggagctggcgagcatggcggcgaagtgatctattccggtcccgcgaaaaagctcgttgacgctccgcgttcggttacgggcgactacattgccggccgccgaaagatcgaggtcccgcagtcccgtcgcaaagtacgtaagaccaagcagttgcgcgtggttggagcccgcgaaaacaatctgaaggatttgacggtcaacttcccactgggagttttcacttgcgtgacgggtgtttcgggttccggtaaatccactttggtcaatcagattctgtacccggtgcttgccgacaaactcaacggtgcgcgcatcgtgcccggcaagcatacccgtgtggaaggtgtgggccagtgcgacaaagtgatccacgttgaccagaatccgatcggacgcactccgcgttccaatccggccacctataccggagtatgggataagatccgcacgctgttcgccaaaacccctgaagcgcaagtccgtggatacggtccggggcggttctcgttcaatgtcaagggtggccggtgcgaagcatgccatggcgacggcactttgaagatcgaaatgaacttcctgccggacgtgtatgtggactgtgaggaatgccatggcaaacgctacaaccgcgaaacgttggaggtgaaatacaatggcaaatccgttgccgacgtgcttggcatgccgatcgaagaggctgcccagttcttcaaagcgtatccctccatctcccgctatctcgacacgcttgtgcaggtcggacttgggtatatccgactcggacagcctgctccaacgctttccggcggcgaatcgcagcgtgtgaagcttgcgaccgagttgcagcgaaggtctacgggcaaaaccgtgtatattcttgacgaacctaccacgggtttgcattttgaagatgtgcgcaaactgctgcttgtcttgcagggattggtggataagggcaataccgttattgtcattgaacacaatctcgatgtggtcaagtcggccgattggatcatcgaccttgggccggaaggcggtgacggaggcggcaccatcgttaccgaaggtacgccggaacaggtggctcaatgcgaacagtcttggaccggcaagttccttaagggcatgctgtgagcgcacccatcgagcggcacagccaggaggtttggcgcaaaaccgccgaacagttgaacggcgacggtttcagtgtcggtggtgatgattctcccggcaaagacgtaaacaagaacggcgcgcctctgctgggggattcacgtgacctgtttcgtccgaaaacatccgacattccggcgcagccaggcgtatacaagtggcgagatggtgaaggcagggtcatttacgtaggcaaggcgaaaaacctgcgcaaccgtttgaccaattatttccaaccgttgtatcagctgcatccccgcactcaaaccatggtattgacggcccgtaacctggaatggacggtcgttggtaccgaacttgagtcattgacgttggaatacacgtggatcaaagagtttgacccacgattcaacgttgtgttccgcgacgacaaaacctatccgtatctggcgatctcatccggtgaacgcgtgccgcgggtgtgggtgaccagaagccgcaaacgccgcgatacaagatatttcggcccgtacgccaaagtatgggatctgcgtcacagtctcgaccgtctcctcaagacttttcctgtgcgcacctgttcacagaacgtttatcataaggcggaaatcactcatcgtccatgtttgcttgcgtccatcggcaaatgttcggccccttgcattggacgtatcagcgtcgaggaacaccggaagatgtgcgaacagcttattggcgtattaaccggtcgcatcggcaaatcgtatatcgcacagctcacgcgtgaaatgaaggaggccagcgacgagttggagttcgagaaagcggctcggttgcgcgatcagatccagatgctatccacagtggttgagcagaatgccgtggtgttcgatttcgatgtcgatgcggatttcttcggcgtcgattcggacgagctggaagcttccgtgcacgcgttttacgtgcgtgccggttccatccgaggtgaacgcaattggagtgtggaacgggttgaggatgtgacggatgaggagctgattgccgaccttattgtgcaggtgtattcggaaaccgcaggggagacgattagggcttcgcagtcgactgttgtcaccgaacaacgcaatgccatcggatcgacgcaaatcgtgacggcgaccgatgcggtggcacgcgcgcaagctaccagggaacgtaacgagcggcaggatcagaccggtcgtgcggatttgttggctcctatctctccggtgccgcgcgaggtgattgttcccatcgagccggcccggcgtgaagagcttgaatcatggcttagcggattgcgcggtggtgccgtgagcattcgcgtggccagcagaggggataagagacagcttctggaccgtgccaacgataatgccaagcaggcaatgcagcgcagcaagatgagtcgcatcagcgatatgggcgcccgcagcacggccatgaatgatgttgccaaggctttgggacttgaacaggctccattgcgcatcgaatgctacgacatttccaataccgtcggcggagcgttccaggtcgcttccatggtggtattcgaggacgcgattgccaaaaagtccgaatatcgtcgtttcgccattcgcggagcggacggacagggtgcactcgacgatttgagcgcattgtacgagacgctgacgcgacgattccaacatggcaatatcgccggtgactccggcgaaagcatggataatgaacgtcgggcatccgagcatggtgaccagactcatgaaccgactgtccagcagaacaccaatcggcatcatttcgcatacaagcctaatctggtggtggtcgatggcggcaaaccgcaggtcatggcggccgcgaaggcgcttgaggattgcggtgtggatgacgtggccgtgtgcggattggcaaaacgtttggaagaggtgtgggtgccggatgacgactatccgatcattctcaaacgtcaatccgaaggcatgtatctactgcaacgcgtccgcgacgaatcgcatcgttttgccatcacctatcatcgtcagaccagaaggaaaggcgcgttgcgttccgccttggacgatattccaggcgtcggcgaggcataccagaagcgcctactgagccatttcggctcggttcgtgccatgcgtgaggcggatgtcgaggatttcgagcaggtcaaaggcgtcggaaaagccaaagccgcagccatttaccaagcgttgcacgcccacgacgggcaaccgtcgacggaaaatgccatttcgtcgaatagtccgaaagatgaaatggaataagattgggtagcgaaaaaagacaatcggattgctagcatgatgacggtgaatatatagggagggaatatgaccgaggtcaaccaccggtgcgcggttctgggcaagcccatcgcacattcattgtctccggtgctgcacaatgccgcttatcacgcgttgcatcttgacgactggtcgtacgacaagcatgaggtgggcgagcctgatcttgagggctttcttgaatcgcttgatccgacctggtcgggactcagcctgaccatgccattgaagaaaacgatccagccatacggaacaccgtgcaatacatgggccaaagagcttatggttgccaataccgcggtgtttgattggaccaaaacctgcgtcaatggcaattcgaacatccccttcatcaggctatataacacggatgtacgcggcatcgaactcgctttcgaacactcgtatcagacacgtgcgataacgccgaagacggaccgttcgggaacggccgtgatcatcggcaacggcaacaccgcaacgtcggcgttagcggcatgcgtggagatgtctgcgatcggacatgtcatcgttgtggctcgccatcctgagaagaacgccgatctcaagccacttgccgaacggtatatgccatcggaacagccgatcagcattgtcggcatggaccacgccatcgaagcgttgcgccaggctgatgtggcgataaacaccattcccggattggctgcggacggtattgccgaatcattgagaatgccatgtgtgcgcatgcatggaacattgctcgacgtcgtatatgacccacgccctaccaagctgatgcaggcatggcgccaacagggaggaatcgccattggcggcgagcagatgctgttgtatcaggccatggtgcaggtctggttgatgacgggaatctgggatgacgatccgccgagcggtatggttgatcaggattgcaccgcgcgtttggaacaagccatgcgcatcgcgcttgaggaggctctgtgatggcacagaaagacatcgacgtacaggcgaatggcacgcatgccagcgccccttcgccggctgaaggttttgaagtattgctgatcaccggcatgagcggtgcgggccgttcgcatgctgccgacagcattgaagacatgggttggtatgtggttgacaacatgcctccaaaactgctggtgcccttggtggacatgatgaccacgggatccaatattcacaaactcgccgctgtcgtcgacgtgcgttcccgcgactatttcgatgacctgtccgcggtgctcagccatctggacgatcttggtgtgaaaacgcgtatcctgttccttgatgccagcaacgaggtgctgatcaaacgatatgaatccgtacgcaggcctcatccgttgcagcagggcaatcgactgattgacggcattctcgaggaacgagatctgcttgagaatctcaaagaacgtgcggacatcgttatcgacacgtcatcattgagtatccatcagctgtccacgaaattatatgaggccatgctcggatccggtccgaccacggtttccgtgcacatcttcagtttcggtttcaaatacggtattcccatcgacgccgactttgtggccgacgtgagattcctgccgaatccattttgggttcccaggcttcgctcgctgaccggacgcgacaaagaggtgagtgattacgtactttccagcgaaggggccgcggacttcctcgactcgtatgaaaaggcgctttcgattgcgattgaaggatatgcgcaggaagataagcattatgtgactattgcgattggttgcaccggaggccagcatcgttctgtcgcgatgagtgaggctttggctaagcgactgcgtgcgagggggttgtcggtttccgtttccgcacgcgagcttgataagcggtcagcggaaaaatgaccgtattatgagaaaatagtgtccatatgtaaagaaacccggctgtgattgtccaagatattcggtatcacagtaagccgtggcggtgcggaatgattccgcgactcgcctgaaatttagggaagaacagcaaggtaggaggttggctcttggctcttctggatgacgtcaaaagcgagctggccgcaatcgataacgaactgccgatcgccaaaaaggcgcaggcgacagcgatgattcgattcggcaatggtttgcactcggtggatcaccacattctcgtgcaggtgcagctcgactcccaagatgcggctgcttggctgcaggacaccatcaagaacctgtatggtcatgaagccacgcttactcctgtctctaggcagacgccaaccggcaccgtgcagcgttatgtgattcgcgtgccgaagggcagtacggcgctcgtgctgcagaccggcctgtacagccgttacaccaagaacatggtgcttggtcttccaagcgatatcatcaacggcaaaatcgcgcagatcaagtccgcatggcgcggcgcgttcctcgccaacggacgtctgtccgatccaggcaaggccagctatcttgaaatcgtgtgcccgaaccatgaggccgctctggcactggtctccaccgcacgacgtctgggcatcaccgccaagccgcgtaagctgcgcagctccgaacgcgtcaccctgcgcgatcccgacgccatcgaacgtatgctcattcttatgggtgcgccgcgctccgcacgcgagtggaccggaaagcgttccgacggcgaagctcggggcaaagccaaccgtctggccaacttcgacgacgccaacatgcgtcgcagcgccaaggcggctgcggaagcatgcgacaaggttcgtcaggcgtttgagattcttggagatgacattccagacaacctcaaatcggccggccagcttcgtctcgaccatgctgatgcgtcgctggaacagctgggacgtttggccgatccaccaatcaccaaggatgccatcgcgggccgtatccgtcgacttctgcagctcgccgagaaaaccgaaaagcgcgccgccagtcggcttgattgaatcttttatgcaaaacaccatgcctgttttcgaacagcatggtgtttttgttcgtttgggcttgtattattcgtaaatggcaatatggccattccacgcttacaagcggctaggaaaggatatacatgaagacactcaaggatcttggagatctcaagggcaagcgcgttctcgttcgcgccgatttcaacgttccgctggacggcaccacgatcaccgatgacggtcgtatcaaggccgctctgccgaccattaaggccctgcgcgaagaaggcgcgaaggtcattctgatggctcacctcggccgtccgaagggcaaggtcgttccggaactgtcccttgccccggtcgctgctcgtctcggcgagctgctcggcatcgaggtcccgctggctgaagacacctatggtgaggatgcccaggccaaggtcgccgcaatgggcgacggcgatgtcgttctgctgcagaacgtgcgttacaacccggaagaaaccagcaaggatccggaggagcgcgccgcttatgccaagaagattgctgcgctcggcgaagcgttcgtatccgatggcttcggcgtcgtgcaccgcgcacagggctccaattacgacgttgctgccgatcttccggctgctgccggcctgctggtcgagaaggaagtcaaggctctgtcccgcgccaccgttgagccggaacgcccgctgaccgtcgtgctcggcggttccaaggtctccgacaagctcggtgtgatcgaaaacctgctcgacaaggccaaccgtctggtcatcggcggcggcatggtttacaccttcctcaaggccaagggcctcgaggtcggcacctccctgctggaagaggatcaggtcgagaccgtcaagggctacatcgagcgcgctgagcagaacggcgtcgaactcgtgttgccgaccgatatcgtggtgaacccggtcttcccgaagtccgatgaggacatcgctccggaagtcgtggctgccgacgccattccggctgacaagatgggtctggacatcggtccggattcccagaagctcttccacgacaagatcgtggattccaagaccgtcgtttggaacggcccgatgggcgtgttcgaggttccggctttcgctgccggcaccgaggccgtggcccagggtctggtcgacgctaccgcagctggtgcgttcaccatcgtcggcggcggtgattccgcttccgcagtgcgtaacctcggcttcccggaggatggcttctcgcacatctccaccggtggcggtgcctccctcgagttcctcgagggtaaggaactgccgggcctgaaggtgctcgactgattgcttaacgcataaccggaggtgctcccttatcaacaaaaaaggtgggggagcacctcttgttttcactaacccgaaaccacggcgtacgaacactgaatgaaataagaacggaggcaggcaaacacatggcatcgcaacgaattccactggtcgccggcaattggaagatgaacttcgaccatcttgaagccacctatttcgttcagcagctcgcatggaaacttcgtgacattcatttcgactaccgccattgtgaaatcgcattgatgccgtccttcacatcgttacgcagcgtgcaggtgttggtcgaatccgacaatttgaagattcactacggcgcacaggctgtttccgtaacatcgcagggcgcgttcactggagatgtgtctgccgatatgatcgcccacctcggctgttcgtatgtgattgtcggacattccgaacgacgaaagtaccatccggaagatgatgcgaacatcgtggatcaggtacgcgctgttttggcggccggaatgcagccgattctttgcgtcggcgaaagctacgaggaacgtcgcaaaggcattgagcttgatttcgccgtggggcaggtgcatgacgtcacacgcgatctttccgacgaggaagcgtcgcgtctgattgtggcgtatgagccgatatgggccatcggctccggaatggtggccactccacaatccgctcaggacgcggccaaggcgattcgggatgatttggctgaaactttcggcacgcatgtaggagagtccgtgcgcattctgtatggtggctccgtctcctcaaagaacgccgaagaattgattggcgagcccgatgtggatggattccttatcggcggcgccgcgctgaacgtggatgagctcaccagaatctgccagctcaccatgaatgcgacagtatgatgctcgcggagtaatgtttttatcgagttggcctttcaaggtgtggtcattattcgattttctcaataccttgcgctattgttaacagcagtgtttacgaactggaggttcactcgtgtccgctatggccatcgtcaagcttgtgctgcagattattcttgttattttcagcctcttgctcaccctgttgattctgatgcacaagggtaagggcggcggtctgtccgatatgttcggcggcggtctcacccagaatgcgggttcttccggtgtcgcggaaaagaacctgaatcgttggaccgtcatcatcgcggtgctgtgggttgccatcatcattgccctcggtctgatgacgaagttcgatctcatctgattggctttttgcttcggcccatgactggattacagtcatgggccgaagtgttttttatcgtagtattgtctacaacatacgagctaaggattgctttgacgtctttgaaaatcgagaaaacccaagaaaccacgatggtcgtcgcggatttggacggtactttgctgcatgatggcgaaacgttcgaggaacgttttcttacacaacgttccatcgatgtgattaaccgcatgcacgataatggcgtgaccttcgttgtggaaacggcacgtccggtcagcacaggcttttcgttcgtggaaaaactgccggttgatgccgttgcctatctcaatggagcattgatcgatttcaatccagcctcatcaaattatgaaatgctcacttcgccgatgctgccggaagacggccatctcaagaaaatcggattctcctcacagcgagcatgcgaagtctgcaagaatctgttgaatgaactgcccggtatggaagtcggcattgtcatggatgatgtgagatacaccaatttcgatgttacgaaatattggaaaacacagacctggcgatacactgacttcgacgatgttcctgaaggcatcgccgataagctcattatcttccctaacgatgagcagcggaatcaggtcggttctcttgtgcccaacgattttgacgtacatatctctgagggatcgctgtggatgttgatgaatcctcaagccaacaaggagcatgcgttggatttgctggcagaacattttgagacgccgatgagcaataccgtctcattcggtgacgatttggtcgacattgccatgctacgtaaatccggcaggggagtggcggtggcgaacgccaatccgaatgtgttgaacatcgcagatgaaatctgcccatctaataatgatgacggtgtggcgcagtggattgaagataatctgctgtgatgtctcgtgatattcaagagttacatgagttgaacttcgtgaattgaacttttgtcgcaaaaggatgcgaaatggttacatttgatattgaacttccgcaatttcgttagttggtttgtgttaggatttgaactagcgcttgatgaaaattgaactgaaaggactagtatggcggaatcgttctccaaccggttgaacgtcgctatggcgttccgcaatgtcaaacaaattgactttgtgcatgcggctgagaagttcaatatcaaacttggcaaaagtcatatgagtcagtacgtgagcggcaaaaccgtgccgcgtgccgatatcgcccattttcttgcggcttttctgcaggtcaatgaggactggctgatgggaaaggacgttcccatggagcagaacgtcgccaccttgcccgcaatcaagtctgatgaagcccaacatgatagcaatcctgcatcagcgcaatcaacagaaggaaagactatgcgcacctttacgaaatctcataagctcgacaatgtgctctacgacgttcgtggtccggtggcggacgaggcagcacgcatggaagccgcgggaacgcatattctgaaactcaatatcggcaatcctgcgccattcggattccggactccggatgaagtcgtgtatgatatggcgcaacagctccctgaaaccgaaggatattcaccatccaagggtctgttctcggcacgcaaagccatcatgcagtatgcacagctcaagaatattccgaacgtctccatcgatgatatcttcaccggcaatggcgtcagcgagctcatcaacctgtcgctgtccgcgttgctggatgatggcgacgaggtgctggtgccttcgccggactatcctctgtggaccgcctgcgtgaatttggctggcggtaccgccgtgcattacatctgtgatgagggatccgaatggtatcccgatatcgacgatatccgctctaaaatcacggataagaccaaggcaattgtcatcatcaatccaaataatccgaccggagcgctttatccaaaggaactgctgcaacaaatcgtcgacattgcccgagaacatcagctcattattttctccgatgagatttacgatcgtttggtcatggatggactggagcatatttctatcgcatcgctggctccggacctgttctgtgtaacgttctccggtctgtcgaagtcgcatatgattgccggatatcgcattggatggatgatactttccggcaacaagcgtattgcgaaggattacatcgagggcttgaacatgctggcgaacatgcgtatgtgctcgaatgtcccagctcagtcggtggtacagaccgctttaggcgggcatcagagcgtcaaggattacatcaagccaggtggccgtgtgtacgagcagcgcgaactggtctatcagatgctcaatgaaattcccggcgttaccgcagttaagccgaaagcggcgttctatatcttcccgaagctgaacgtcaagaagttcaatattcactccgacgagcagtttgcgttggatctgctgcatgacaagcatattctgatcagtcatggcggtgcattcaactggcagaatccggatcatttcagggtggtatatctgccacgtatcacgatgttaaaggaaaccgtaagtgagatcggtgatttcttgagcacatatcatcaggcatgatgaccttgattgcttgaagggctttcatagtgtgaagtacgcgcagcatcgcgacactccgtccccaaatacttatagttatactgaccataagtagggctacgatggctccggccttagggccgagccatcgtttcattgtgaaaggggatattgtgaacgatttgctcaaaggaatcggcaacgtcgtcaatccgaagcgtgtgttccgcgagctgactgacttcaagccgggggagtttgtcctgatcacggtcatgctgttggcgcagttggtgtcattcttcgtgtccaaagattttccgcggcaggttgaattggtctgatttccggcctatgcatcgtgttcaatctcattctcgtcgaccgtgggcgactgaccaactatctgtggggcttcatcggttgcgccacttggctgatcgttgtcatcatgaaccatctcgtcggagacatcttcgctcagatcttctacgtcaccatgcagttcgtcggcgtatgggtgtggcagcgccagcttgatcgtcaggaaaaaaacgagtatgaggaagtcaatgcccgcatgttcacatggtggcaaggcattctcgccgtcatcgcaaccatcgtgatctatctgattgtggtattcgtgtcgagccatactggcggtgtacaggttcggcttgacggcacgctgctaccgcttggtatcgtcggacagattctcatgacatacggctaccgcagccagtgggtcgcatggattactcttgacgtgatcaaggtggttatctggttcaaccagctttccgtcggaggtcctggcgccatgtcgatgttcgttcttcaggtggtcatgttggccaacggtttttacggcgcatgggtctggttccacaagagcagcactatggccgtatcggatgatctgcaatcaagtatttgcacggaaagcataatcgcaaatggtggccgctgatcaatcaatcgttccgtcgcgagttcacaacgatcatattggttgttgggccggcttccgtcggcaaaaccacattggtgacacgcttgtcgaaattgtatgacgctccgatcgcggtcgagtatgcccgtgaatttgaggaagcctgcaatgttgacgatgatgaacttaccgctttcgattacgagcggctgattctttccaagttctctcagaacgagcatgcaatagcatcgcatgccaatcatggcatcgtttttcttgatactgatgccatggttacgcgtgtctatgcggaacgctatctgccggccgatgagaacgccaagctgcaagccgacattcgatatggtgattgaacaggagaagcctgatctggtgttgctgattcctccgatcaccgaatatgtggatgatgggttccgtgcaatgcggtgggcttcggatcggtatcggttccatgagactttggtacgcgtcattcaggagtcaccgtatgccgaccgtgtggtgacgcttgacaatccaacttttgaagggcgcaaaacgcaggcgattcaagcgatccgccaggccactggttttacgcctcgtaccggaataagctgaaaacatgtagagcaatagcagaaaccccctgccagaattctggcaggggggatccttagcttagatcgctaacacttaagcaagaagctcagccgttgacgcggtcgatgccagcctggacgtcagtaaggacggaatcccaggacttgatgaaggaagcgacgccgtcggcttccagcttgtcggtgacagccttgaagtcgatgcccagctcagcgagcttggccatgatggcgtgggactcttcgtaggtacccttgatggtcggagcgccgttgccgtgatcggcgagagcgttcagggtcttctccggcatggtgttcacgatgagcggggcaacgagctcgtcaacgtagacgcaatcggaataggccgggttcttagtgccggtggaggcccacagcggacgctgcttcttggcgcccttggcttcgagagcagcccaacgcggatcgttggcgaacttgttctcgaacagctcgtaagcgaggcgagcgttggcgatagcggccttgccctcgagagccttggcctcatcggagccgatctcctcaagcttgttgtcgacggcggtgtccacgcgggacacgaagaaggaagcgacggaaccgatgtgcttcaggtcatggccgttggcgtcagcctgagcgatgccttcgatgaaggcatcgatgacctgctcgtaacgctcgagcgagaagatcagggtgacgttgacggagatgcccttggccagggttgcagtgattgccggcaggccttcgagggttgccgggatcttgatcatggcgttcggacggttgaccttctcccagagctcgacagcctgctgctcggtggcttcggtctcgtgggccagacgcggatcaacttcgatggaaacgcggccatcgacgaaatcggtggcttcggcgatctcacggaagatgtcggtggcgttgcgcacgtcggtggtggtgagctcgcggatagcggtctcaacgtcaaccttgccgagctccttgagctgtgcatcgtacgggccgacctggctcagagccttctggaagatggacgggttggtggtgacgccaacgacgttcttgtccttgatgagctcctgcaggttgccggattcgatacgggtgcgggacagatcgtccagccagatcgagacaccggagtcagaggtgcgctgagttgcttcagtcattgtttttctccttgatacctttttggatcaaatctttatttattgtgcggtaaaaggggagaggcacatgcatcatgcccctccccgtcgaatcacttggcggcttcgacttccgcaatggaggccttggcggcttcgacaacatgctcggcggtgatgcccaggtcgatcatgttctgagcaccgtcgccctgcaggccgaactgctcgatggaaaccggcttgccgtaggagccgaggtacttgtaccacggcatggcaacgccagcctcgacggagacacgagccttgacggaggccggaagcacagcttccttgtactcggcgtcctgctcctcgaaccattcgagggacggagcggacacaacgcgagccttaatgccttcaccagccagggtcttggctgcggagacggcccactgcacttcggaaccggtggccatgataatgacgtcaggggtgccctcggtgtcgacaagcacgtaagcgcccttcttgacgccgtccttggccttctcagcggtttcggcaagaaccggaacgccctggcgggtcagcaccatggctgcaggcagagtgttcttcttctcgaagaagtaacggtaggcttcggcggtctcgtaagcgtcggccgggcggacgacctcaagctgcgggatggcacggaaggaagccaggtgctccaccggctggtgggtcggaccatcttcgccgacggcgacggagtcgtgggaccacacatacaggttcggaatctgcatgagggcggccagacgcacagcggaacgctcgtagtcggagaacatgaagaaggtgccaccgaacggacgggtatgggagcccagcaggatgccgttggtgatggtacccatggtgaactcgcgcacgccgaagtgcagctgacggccgtacgggctgcagaccggccactgcttggtggcgcactcggcaggagcgaaggtggcagcgcccttaagatcggtcttgttggagccaccgaggtcggcggagccgccccagagttccggcatgacagcggcgatggcgttcagcacggaaccggaagcgccacgggttgcaacgcccttgccgacttcgaaggtagcctcgaggtcatcgatggccttgtcgaagccctccggcagttcgccggccttgaggcggtcatacagggcagcgttgtccgggttggccttgcgccatgcgttgtacttctcgtcccattccttgtgggcttcgaggccgcgctcggcaaccttgcgtgcgtgagccagagcctcttcgtcgacatggaaggactcttccggatcgtagccaagcagttccttgaggcctgcgacggcttcggcgcccagcttggagccgtgagaggacggatcattggtcttgcccggggtcggccatgcgatcagggtatcgaccttgatgagcttcggctggttcggagcggcctcgcgagccttggcgatggtgtcggccagaccctcgacgtcctccttgtaggagccgtcaggctggatgaagctgaactcgtcggtgtaccagccgtaggcctggaagcgcttgagcacgtcctcagccagaaccagattggtgtcgccttcgatctggatgcggttggcatcgaagatgacggtcaggttgcccagctgctggttggcagcgagggaggcagcttcgccagagataccttcttcgatatcgccttcgccgcagatgacccagatgttgtggtcgaacggggattcgcctgccggagcttccggatcaagcagaccacgctggaaacgctggccataggcgaaaccaatggcggaagcgaagccctggcccagcggaccagtggtcatttcgatgcccggggtcagaccatattccgggtgacccggggtacgggtgtcagcaccgccgcggaagttcttcaggtcatccagagtcaggccgtagccggagaagtacagctggacgtactgggtgagggaagcatgaccgccagaaaggatgaagcggtcgcgaccttcccaattgggatcgttcggatcatgcttgatgaaatgctggtacagagtgtaggcgataggcgccagggagacgggggaacccgggtggccgtgtcccgcacgctcaaccgcgtcggccgacaggaccttggccatcttgatggcgcgctcgtccagctcggtctccttgaattcggtcatggattactttccttccaattggtcgggccgcgtatccggcttgtgccgagcgctcgacgccctcacattgcgttttccatagtagcgatgtgaggtgacgttgtggtggatttttggcgtgttttggtagtttgtgttctgttaacgctcacagttaacattctcgtgcgattgctctgttcgattggtggtatgacgagcatttcgggagattgctatcgggaaaaacgagaaacgagtactctggaagcgaacgtattagcactcgcgcctcgcgagtgctaatacaatgggagaagtatttacggaagacggtttctcctaatatcgcagatattccgaaaaccggctcccgctgaatcgtatcgtgtatacataaagaggaggcacgcatgacgcagtcaagacgtatgttggtgctgcgtgccgtcgtcgaggactatattcgctcgcaggagccagtcggttcgaccaccttgaccaaagatcatgatctgggcgtcagctcggccaccgtccgtaatgatatggccgccttggaagatgagggatatcttattcaaccccatacgtcggcagggcgcataccaacggaaaaagggtaccgatacttcgtggaccgcttggccacagtggtgccgatgtctgaagcgcaacgccgtggcatcaacagttttctgtcgggatccgtcaatctgcaggacaccttgcagcgcgcagcccgccttctggcacagatcaccggtcaggtcgcggttgtggcggccccgtcgttggcgaaatcgacattacggcatatcgaaatcgttcccgtatcaatcaacaccctgttggccgtcgtcatcactgacaccggccgagtggcgcaacatatactcaacgtttccgagttgccggacaccacagtgctgtcgcatctggtcaacgaaatcaacgcgcagtgtgccagcgtttctttgacacgaaccgcggactatgtcaggcagatgtcatcccgcaaggaataccgccccatcagtaaactggcggaaacgcttgctcaagctttcgatggcatggccgacgacgagcgcgcgagcgaactctatatggcaggaacctcacgactcgcgcaccagcgtgccgtggccgatcttgcaccattgttcgatgcgctggaagagcaagtcgtgctcatgaaactcatgagcacgttgagcgaaaccacgcaatccgatggagtcggagtggccatcggctccgaaacgcacacgcccggtctgctgcatgcatccgtggtgaccagcgggtacggtcgaacctcggcaaccgctgacgacgtaacaaaaggcgagactgcggaggagcaggggagagagacaagcaatcacaccactgcagcgcaggattccaccgagcccatcgccttcgtcggatccataggaccgacgcatatggactatgcggcgaccatggcagcagtgcgtgccgttgccagatatctgaccgcattcgtggctcacgacgaaaaccaaaacaacagctgaccccgccttatggcacaatgacacgcgaaaagcaatagggagaaagaacaaccgtgacggactattacgaagtgctgggcgtagaccgctccgcaagcgacgacgagatcaaaaaagcttatcgaaagatgagccgcaaatatcatcccgatatcgcaggtccggaattcgaagacaaattcaaggaagtcaataacgcctacgaagtgttgtccgatccacagaagcgtcagatgttcgacgccggcgtggacccgaacgatccgaacgccggcggcatgcatggcggattcagcggcggattcggcgacatgggtgacattttcaacatgttcgccggaggtgctttcggcggtggcaacggcggtccgacccctcgtacacagccgggacgcgatgcactggccacagtgaccatcgacttgaagactgcggtgttcggcgacaccgcacatgttgaaatcaaaacgttcggtctgtgccaggaatgcgccggcaccggatgccagaaaggtacccagccggcacagtgccccgactgccatggtcagggctacgcacagcgcgtggtgcgcaccatgcttggccagatgatgaccaccgctccatgcgagcgttgcgagggacatggtaccgttatcgaaaatccgtgtccgtcctgccttggtcatggtcgtgtgcgtatcacccgtaatgtcggcgtgtccgtgcctgccggcgtgacgaacaatacccgtctgcgtctcgctaatcagggcgaggtgggtgaaaacggcggtgttgccggcgacctgtatgtcgacatccgcatcgctcaggatgacaccttcactcgtgacggtgatgatttgcactgctggatccaagtgccgatgagctgggccgtactggggcatgatctggaaatcgacacgttcgatggcaagcagtctgtgagagtgcctgcaggaagccagcctgacgacactgtgaccttgaagaatctgggcgtcacgcatcttaacaacaagagcgaacgtggcgatctggtggcgcatatcgcagtgaagattccgacaaagctcactgacgacgagcgtgccttgatggaacggtttgccgaaaagcatgacacagatgcccaacatgttgcggtaagcgcacgcccgacttccggaacgaagaagggcttcttctccaagctgaaggatgcactgcgctgagcgagggttggaaatagccgctttgccttacgggagtaaggctgagcggcttttcttattcccgccgattccttcgtattccctcggtttaccggaataatgtgggcaaaatgtgggcaaaaaaatcgggcccgcgaagccctctgccacaacgcgaaatcggccccgtccggccgcagtcaagctcatggagctgtctgcgatgccggacggggccgaactgtgtgtggtggtcatgcggcgaggtcgatgcgctgtttgatggcgctgacgccgatgagagcgccggcgaggatgccgagcgcgttgagcgtggtcactatcgcgtccacgtgcggccagccccatgcggggccgaccgtgcccacgaacacggcgagtgcgggcaggacgatgaggcccagccatttgagcacgtcatagacgcgattcggcagcagccaatcggtcacggtcggctctgtgccggcggtcttgggttcggtgttttcgtcagtcatattgtgtactcgattctgaatatgagcctgggggcctcgcccggtgtcgggttcgaggctcctaggtagggttcgggctatcagtaatgcagcacttcgcccgggtagataaggttcggattaccgctgtggtagccggtgagctgcgtgtagccgatgccgaggcgtgccgcgatgccgccgagcgtgtcgccgctgcggacggtcacggtgcgggtggccggtggcgcgttgctgccggtggcgatgctgccgccgccgttgtaggtgacgacctgaccggggtagatcaggttcgggttgccgctgggcacgctccacgcggacagcggccacaggccggtacgcgaggcgatgccgctcatggtgtcaccggagcggacggtcacgcgcgtggcggcggcggtcgtctgccgctgcacgacggtagtggtgccgttgagtcgctggttgacgatcgccatgaccctgtcgtagttcgcgccgagcgcgtcgcgccgctgctggccgttgccgtagtcgccacggatggcggcggtggcgagggcctgtaggtcgacggtctgggtcggcggcttctcggcctgcggcggggtcgtggtctgggtcttgcctgcggggttggagtacaagtcccactgccatgcctcgccacggaaaatgttaaggtcgatggggctccacgtgttgaccacgcccgcactactgtactggcgcatggcctcgccgtacacgccgatcatccacggggatgcctgatagcctgtcggagacgtgttggcgtactgggcaatccataaaccgtatttggcgcggatgtcgctggggatggtgctggcgaccggggcggtgtacagcagcggacgcacaccgccagaaaggcgttcgcactcacgcatgaagcggcgtacccaatcccagttgccccatgcgggattgtcgtccatctcccagtcgagcgccacgatgccgtgacgccaatagttgctggtgttgcggtagaagaattgggcctcggcctccgggttgccgcccatagcgtagtgatacaatccgaatttcttgccggatgcctgcgcttgggcgatcatgcggttggcgtcggtgttgacgccggacacgagacagttgttgttgacttggcccgtgccccatgtggtgccaaccaccacgaagtccgcctgcgtgttggcgatgtcgatgccgcactgccagttggatacgtcgatgccctgcatgtccgcgtgcgcggtcgccggaagcagcatcatgcacacggcggcggccagtgccgtgaccttggcgagcagacgcttatgccacggcttgtccttgttattgaccatatgtcccctttctcgggatgaatattgttttgtggcccacggtcgtgggtcaggattatcgggacaccatgaaaaaagccccacacggtatggtgtggggctaaaatcagtcgattttgtagaggcggggtgtgaacgtcttatcgacctcgcccgtggtgttgatgaagatgttgcagtcgagagtgccggccttcaaggttttcggcccatagtcccgaggggcgaacacgtttgtgcgtttgcttccgtcatcgggggtgagcgtggcttgcaggccaaacagccatgagctgttgcccaaaggccagtcggaggcgtccatcgtgtacgttccggcgtcaacatgcaccgaaaccgacaagtcaacccatgagtcgacagatttcgtggtggaacccttgaacaggtacgtgcccggtgattgttccgtgaccgtaatccccgggttggcacccaacgttttaggcaggccggtgacacgcggatacaggttcgctagttcatagcctccccctaaggctcgtgttatccggtttcatccaatcgcgtgcggtgtcaccggattccaactggattcggaggtcgccgtccttcgcggtgggcgtggcctcagtacacaggatttcgaagcgcaggctgacggtgccggcggggattaccccggcattacccacgttgagctggctccccagttgaccacctttggcgtcaaggcatttgacgctgacggtcagaccgtcgacactggtgggcctgctcaatatcacggtgccctgtaccgggcaggggaacttccacgaaaggcccgcccattgcttgacggcggtaccggtgacatgcaatgacccgtcactgttgacggtggcggtcaaaccgttgccctcggcgggaccataggacaacaggttacgtgagagtaccgtaatgggcactgttttcgtgactttgcctgcggtcagtttcagactcgtggacccggttttgagaccggtgatgttcaattctgccattgtcatgactccttggtgacggtggctagcgtcgtgttagcgatgacggaagtaaactcctgcgaggcggcggcgggcaataccgcgatgctgagatgcttggtctcgcctacgcgcagggtgactgcatcgaccggctggccggaatcgtccgtgaccctgatgctttccggtgcgtaggccgcgctgatggacacggcggcggaagtgaaaccgtcgacagtggcggtgacgagaatcgtgccgccatgcctccacgtgagcgtgttgcccgaaaccgtggcggtgctcgtgtccctgctcgtgaacgtcacgcccttggtgggcagcaggtcgccaacatgcccgtccgcataggtggccttggctcccagtttcagactgccgttgacggccagagacttgggcagggcattgcccttatcatccgtgatctcgatggagaccaccgtatccttgtcgaggggccatacgagcttgccgttgaatagggcgttgtatgtgtgaccgcccatcaatggtttgccgacacgtttgccggcgtataaggctggcatgatcaggcctccttcacagtggccttcttggccttggctggcgtggagtccttgccgggttcctccgtggtttcctccgtggtttcctcggcggtgccggtggaaggcagtacggtggtcgcagcctccgccttatccttcaccgcctgaaccgtcgaatcgatggtggcgatatcgctctcgcccttcgccgcaaccgcgttggcggtgtcggccaccgtctgcgaatcattggcgacggaagccgccgccacactcgcgttcgacgcgagaacattcaaattggactggacggcggtcgccgaatccgcggaggaccgggcgctcagcatggcgctcttagccaacgcggcgttcgtctgcgcttcggccgtgatggactccaacgtgctcatggccatagcggccctcgcggtcgtggccgtttcgtcgaagaacaccagctcgtccgggtattgggcggaaagcgtctccgcctccgactgggtggaagcgcggcgaaccttcaacagttgggagccggtcatgtccttcggcacgaacgtgccggcgtccacttccacgaggtccgcgtattcgaccttggtcttggagttcggcacctcgacgtaacgcgtgtacgcctgcggcgtgtccgccaactcgatgacctgccagacgaacgcgcccgtcgtgggcagcaggtcaaccgtcaactcaccgtcctcggacaagtccgcgtcgaacgaagccgcgatgacaaggttcttcgccgcgtcgaaatgacgacgcaccggacggaacctcatcacgcccgtgaccgggtccaagccacccgtcttcggcttcctaatgctgatatggatttgggtcatgattattactcctccttaatggattcgatgatggtttccggagccacgtccgggcgaagctcgtccggcaacgatggtttcggatgacgcttcaaaaactccggctccgcaatctcgcagaacgattgcagccagtggaacaggctgcgcgtataggccacggccgtgaaatacttgcgttgaacctcctccaaatgctgaatctgctgctcctgataggtgacttgctcgcgcagtggattgatgatgctgtccgtgagaatcttcacggccttgtcggccgcgtcggcggtgaggccgtcgatatcggcctcggttttccgccggttcgaccacgcgcccacaagaccaccaagcccaccaccgccaatgagcgcgagaatcaacgcgctccaaaactccacggaatcgaataactgttgaaatgggggcatcacgttcccttcttcttttttggaaaacccacacgtttcacccgtttggacaggccagacggcgtgtgggttttggaggttgaaaatgctgttacgagagttttgggccaaccggttttggccgtattgcacgcggaatctgcgtgagagcacgcgcgtgggctacgagagcgcgtggcggttgcacgtcagacccgtgttcggcgcatcggatatggacgcgataagcgtggaactggtcgacaaatggcttgccggtttcgatagcgcgggcgcggcacgcaaggcatgggccgtactacgcgcgatgctcaggcgggctatccgctggaaccttttggacgtggacatcacgaggcgtgacatccaactgccggccaaaactcattacgagccgcgaatattgaccatccgtcagcagcgcacgctgttgcggggcttctacgctcaccctttggaagcgtggcttatctgcgccgtctcatgcggattgcgtaccgaggaagggtacgggctggaatggtcggatattgacctgcgctcaggagtgctgcatgtcgagcgtggcctgcaatgggtgggcgggcatgaggtcacagtgccgccgaaaaccgaattgagccgccgcacgctcccgttgccgcgcttcgccgtcaaacgattgcgcgaaatcaagccacgcgagggaggccgactcatcggcaccctcaccccgccacaagccgcacgccaatacgcgagctggtgcaagcggcatgatctgccgcatgttcccgcacgcaacctgcggcactcgtgggcgacgagcactctggcggctggcgcggatatcgccatcgtgtcgaaaatgctcggccacagcgatatcaaaaccaccgcaaagtactatttaaagccggatatcacggctttgcgtgacgcgcaacgcctctgggagcgagccttggtcgcctgagcgggattccctaacccagcgttccacgacatggaaggtgccctacagcagagacactattgcgctgactcgcgtggggagtatctgcttcatgggcggcaacgtgaaattcaaccatagtggcgagaacaattacgcacaagcgtcggagaccatacccgtggggtatcgtccagcggaaagaacgaacactccgatagccgtgttcggcggcaacaccacgttcatcctttacggcgagcatacgggccgtgtgaccatgctcggcaacccgaacagtgcgtacgccggatgcaccggcgtatggcgcaccgccgacccgatgcccgccgcatagcttcgggacactggttcaggcggttgcgctgtcttgcagtgaccccacgggtcatagcacgtatgagacggtcaaaccgaacgcgctcgcgccctgcgtgccgccctgattgacgtaggtcatggttccgtccgcatgtatgttgatggtcttctggttcgctccgtcacgcccgccgtaggagaagttcaaatccatcgggggacgccatccttcgggcagggttccgaaattgccggtgttccaagagccggaggccgatgacttccaatcgattcgcaacgtcgccacaaaacccgactggtagcccttgaccgtgccgtaactactgtcgataagggtcgtgaccggcgtatgggttagggaatcccacacgtcgctcatcggccgcaaaacgttgaacaatggcactggtgtgccgatggtgatgccgtccaacgggatgcggtacaacggcatatcgtaggtggtgcccccgtccaacgggctggtggtgttcaacgttgggtcggtgggcgtgcccgtggtgggcgtgcccctgaccaccaccagttccgcgctctcaaccgactgcgagcccttcgcatagcggcatacgatcagatcgttgcgtttctgcccctgactgccgttcgtgacgatcaggtcctcgggcgtgccctggctgacgtgacgcccctgcatgaccagctcgcccgtgccgacagtcaccttgttcgccgaaacgacggtgatttcgaacttatcgtgcacgtcgagcacataatcatccaaaccgaggatgccggcgttcaatcctgcggcctgttccgccgtggcgtgcgccttgttcgcatgtccggttacgagttcaaccattctgcttgcctccgttcttcttccatgattcgaagctgttgtcggcgtccctgagacggttgacgtattcctggtggcagttggagcagaagtagtagccgtgttggttgccgtcggcgtcgaggcgttgcacgtcccaccagtcgtttttcagggcgtccgcgttcgatggggtgtaccaggcgaatcttccgcatcggtcgcattcggcgacgatgcagtcgttgttcttggccatgacgttcctttctattcggcctcgtaatcgacgcttaggacgccgcccgagaccttgacgattttcttgctgatagtcgcgttgacggtgatgcccgtgagattgtcacgtgcggtcacggtgtcgccaacatcgaacaccacgttcgcgtcgtcgcggacggtgaccttcacatcgccctcggactgcagatcctgtagtttctcacgggtcttctggttcagttcggcggtctcggcactcgaatagtcgtagacctgcgttatctcgtccacgcccctgagcgactgggtctggctgacgttgcccgcagcatccgcgtaccagtggacgaccgttcgaccggcaccttcgcccttgcccaggccgatgagatgattcggtttcttccatgtgcgggtcgcgtcgaaatcgatcaaatcggaatcaatcgagtcgccgtaatgcgcgaccggttcggcccaaatgttgacccggccggacgcataggccattctgagcttcaaaccgctggccgcgcacatcttccgcaaaccggtatacgcatccacgtaacggtcgaactggtaggttttgatggtcgggtcgtctccgtcaggtggggcaaccgcgccgaacaccgtatcaagcctcacacggctgatgagcgagccgatgaccgaggaagcggaaccggaaaccgtcagataatccttgcccttgtccggctccaaaatcttgtccgccagcacgccatgccacgtgcgacccgaataggtgatggtactgacgccggaagtgagctggtcttccatcgcatccacgattccgccgcactccgaaccatccagatacacgtaagcgcccgaatcgatcaaacgcggcacggtcaactcaaaatcgttctcaccgcttccccatgcgcaatcgagcgtgtattcggcgatggccgatgtatcgacgtgcttgccgttggtgatgatcaggtcagccatgccggcacgctcctctcgcggatcacggttaggtcgaagccgaagcctttccattgcacttggtgctcaccggacggcagtggttcgaaaatgtacgagccggagcccatgccagtgcctctttcgcctttggcgaacacgttcgtgaggtcgccgttctcggccgtcatgacaatgctgcgctggccctcgacgctgttgatggtcacatacgcgccactggggatgtccatatgcaactcatatgtgttgcctcccatcgtgatcgacggctcgctgaccggcccgtagatcaccatctcgaacggcatcgcggaaaccgcgctgtttacgaccgaagcgtttcgcgtcgtcggcatgtaatcatgcggataatccaaatccaagccgggctgcaatgcgtccgaccagaaatgctgcacgtcgtcgcgcttgcgccacaggccgtcgagcaatgcgacggtgagcgtgtatttcgcggggccgggcgggtcataggatggttcgattccggtgacgagcgcggtctgcgaccagccgtccacggtgagcagaccggaatcggccttgctacgggacgaggccacggccttaacgtccgcgtcgaacagttcgccagccacgtccagcacgttgaggtcggcgcatgtagcctccaattggacgcttgacgcgttgagggaggcggagtcaatgccgtgagcggccaactccacctcccacgcgtgcgtgcgcaatggttcgatgcgtttgaccatgagccccgcagggtcgatgaggttcacggtgcgatcctgtgtagcaccgcaccggtaggtcattgtctgcaaaccatgcctccaatcagatgatgttgaacgcgcgcttccactcgcgcaggctcatggtcggcgcgtacttgccaatggtcggccccaaatcctcatgcagggattgcagatcggagcgcaggccgcgaatctcggtgatgatggtcgcaagatcggccagaccgttgccggtggtggccgaagcgactgaatcgtccaatccgatggcggagcgcagcgtcatcggcccgaaagccgattgggcggcatccgtcacgccctgcacctgccggactatgttgcgctgcaaggcgggtgtcgccttgtcgatgccctcgctgatgccgggcggaatgtaacgaccgacctcatccctgaacactcgcgacggggaatggatgccgagcgcctccttcgccttatcgaccagaccactcaaagcgcccttgatgttcgcgtacaatccgccgatggcaccgctgatgccgttccacagaccactgatgatctgcgcgccggcgcttacgagcatgctgcccgccccggcgaacgcgccccggatggcgttcacgatgcccgataccaagcccccgacggctccggcagcactggaaagaatcgacttgaaactgttccaagcgcctcgccagttgccgttgatgaggttggcgaccatgctgatgacaccggagatgacgccgaccacgccccgtatcacgccttgtatgccgttgatgacacccgacacgtaggggagcatcgcctgcaccgcaggcaacagcataccggtgatgaatccgatgattgcgctcacgacaccgctcacgacgctcaggatgccttggatgacgggcatgagctgctggatgataccgatgatgccggtcaccgccccggtgacgaccgtgacgatctgctggacgatcggcacgaccacggcgacgatctggctgatgaacgacatgagctgctggatgatgggcacgagcagcgcgccgatctgctcggcgacctgcactatcatgccgatgatctgaccggcgactggcagcagcgcggacagcatctccgccagcgggggcagcacgccggacacgatctgaccaatgaccggcagaatcgcctccagtgccgccatgagcggttccatgattgtggggatgagcggcagcagcgactgcatgatcaggccgaccacggggacgagcgtgcccaacgcgtccgtgatgaccggcatgatctgtttgactgtagccttaaaggtctcggacagcttgtcaaataccggcttcatggatcggagctcggctttgaaccgttcaaacaaggctcttgcctgatcgccgaacgctttcttgagctcaggagtcgtggcaataagtgtcccgattgcagccaccaccatgccgataggaccgccaagtgcactcaacggtccagccaatcctcccaatacgccgccgagtagtggaattttagagagcaaaggcgcgatgccgcccattcccagcgctgtgaacgcagcgagtgctggagcaatggcattgccgaggttcttgaacacgcttccgacggcatccaccgctttctggaacggtgccggtaggagatccacgagactgttgaacagtgagggtatcgcagagacgacgcccctggcgatggctccgattcggggcacgatgttcttcaacgcggtgccgatggattctgccaattgctggctgagagcgcccatgtcggcgttctcgttgcccagtccggccagccagttctgccaggcggccttcatcgcgccgaccgaaccctcgatggttttggctgcctcatctgcggtcgtgccggagatgcccatctccttctggactcggctgatggcctcgactacatcggagaatgagtcgacgctcaggtcgttgccgtccttgagcacgccgggcagcttgtttgcatccgagatgaggcgttccatctcgctcttggtgccgccatacctgatgttcggcagtgtgcgctaggcactgcccgccccggagggctgctgcacgtctccgtgcagagcagactatctcttggcgggattcacccgtccctcgcacttccgtccgcttgggcgtactctactcgcttccgccatgatgacgtgctttcgatagtcgttacacgttccgactgggaattgtcggcttcgcacggtattgccctcggcttaccgtaggggttccaccgttttcacgaggtttatactgagcaatttaagcggctaatgctagtctacccagtttcagattgtccaacatggcgtaattgccgcgagcgaggctctgatacgtctgttggacggtctggatgtcggtgcccatcttgttggcgttgtccgacatgtcagtgagcgccatgttgcccattttggcggccttggcggtgtctccgccgagggagctgatgagcgacgccgagaagctcgtgacctggttcatgtactcgttcgcgctgacgccggccgtcttgtacgcttcggcagcgtacttctgcacggtgccggaagcgtccttgaacagggtgtcgacgccgccgaccgcctgctcccacgtggcgtacgcgcccaacgcctgcttgccggtggccaccagcgtgccgccgatggctgccacacctgctccgatggcggcgaccgcaccggtggaaagtcccttgagcgcattgagcgacgtggaggcgagggctttgaacgcgttcccagcgcttgaggccataccacccaatgcgccgccgatggctcccgcagcggactgcgcgccggacgggagcttcgcccacaccgcgccggcggcagtggcgatgttgccgaagtagttcttggctacgttggctaccggtgcgagtttctgtcctactgttcctacgacatctccgatggcggagccgattttgccgccgaatgatcgaatgggtgcggtccaagtagcgactgccgttttgatggtgttgccggtgcggcttccccagtcgcgaatcggttgcgtccatgcggtgattgccgcgccgattggtttggcgatgcctgacacggtggcggcgatgctgccgccccatcctttgagggtttgctgggcggcgctgatggctcctttgaggccggtttggattttcgcgccggcctgtacggcgaagccgctgagtttggctactgccgtgctggcgaagccgctgatcttcgcgcccaacggtttccagatggcatccacgccgagcaggcttcgcacgagcgaacccaatgcgccggaaagtccggtgaacgagctctggcctcggctgatgctggcgaatccggccttgaacgagcttgccatcgtcttcacggatccggacaccgtgttggtgcccttggcgagttcggcctcggcggccttgagcgccttcttcgcgtccgcgagccgttcggcggcgtcgttggacttgtcgagagcggtggcctgacgcaactgggctttctcgaggttgatggaggcggtctgcgcctgagtactgtcgggcccgtatttggcgatggccgcgttgagcctctcctgcgcccgctgcacgttgaccgtggcctgacggtagttcaggagcgtggcactggccttggaggacgcctgcgccacgtcacgcttcaacggcttcagcacctcgtcggcagcgccccgggcacccgcgccgaacgcctttttaaagttgccgccaaacgatttgccgattttcgaaccgttgccgaacgcctgcgagaaacggttggaaccggacttgccggctccccgcatctccttgtcgaccgctgacctgaatcccttcatcgaggggaatatcgacacgtggccggttcccacttccgatccgaaagccataagacggctcctttcagtcgatggttgtttatccgaagagcttgctcatatgagattcggcctcgtggatctcctcggcggtgggctcgtccgtttcgggttcgccgtccacgtcgccgagcagcgtggaagcgccgataagctgcaatacggtgatgtcggtggcgctcatggggaacatgaggccgatgagcgaggctcccgtgtaggaggccgggtcgccgcacaacgccgtgtacaggtcgatggcgtcacggtaggggagacgccggccgagatcgtgttcgacgctccacccgaatcgggcgaagtcggcgcgtatccttactccgtcttcggagttgaggattcggcagaagtctgcgattttcccagttcgacgccctgcgatttggcgagcgtctccccataatcctggatgaggttgaatgcgacctgcatgggctccctttcgagctgcttggcctgctcgtcgccggcgaacacggtgaggatgcgtttgacctggtcgaggctgtcggtgtcggtggacgcgccggacagggcctcgaagtcggcgatggaaagatagaggggcagtttgtagacggtgccgccgggtgtcagcgcccagtattcgttgttcttgatgatgtggcgcaccttgacctgcttggcgacctcggcgagggcctcggtttccttggtctcgtcccaatcatcgaattcggcgatggtcggggtgatggattgtgtcttggccatgatgtttttctcctgtcatatgtgtttctcccgtcgttggtgttggggctccccgcatgccgacaggagagaggtcatgcggggagggaatcgttgtcaggccgccgcgtaggactgcaggtagcggctgttgccgccgtccacggcgggatcgagctgccatgtggcggtcagcgagaggccggacacctcgccgcgcgtatcctgcgccggctcgttgccggtgatctggatgacgccgagacgacggcgcttgcggccgaacttgtagatggtctcctgataggcgaaccacttggtgtcctggatgatgtcccggacgtggtagacgccggtttcatcgggcttgccgatggttatgaggcgggtgaggtcgttgtcctcggcggcggtgaacgcgagcgtcagcgtcgggtcggcgttgagcgtgtagcccggctgatggaattcggtggcgtcgtcgccgtcgcgcgcgtcctgcggcgctccgtcgctggtgatgaggcccacggcggcggagtcggaaccgaacacgtcgccgagttcggtgatcgggtccgccacggagggcgcgatctgcgaggcggtcagcgtcttgcctgccacatagggggcgacgatgattttcgatgtgagtacgttcttgacagaatcaaggtcgttgccctggttgtctgctgtcattccatgtcctttcaaaatgaaaagaccccgcaacgcatgcagggtctaggaaaacggttaagggattggttagtgttcgccaaccgtcgaatattcgacgatcaggtagtagtgcgcggtgtcggaatcgtcggacaccgggtagggcccgttgcacgcggaatcgtccacgccgatgaccggcgaatccttggcgagggcgatggcgggatgttcggtgagcgccgcgtagacgcggcgggccaaatccttgcatggcttctcggcctgtcgactccacccgtacacgtttacgccgatgcttcggtcgaaattgccgagcccgtcagcgttgccgccatcgtctcggacggtgacgagcggatacgcgccctgatagtcgggaggcttcttgctgcccacctggagcccgtccacatcggtgatatggtcgcgcaggtaagtgcagagaaaagcctccatgtcgggaggcagtatcaacgtcatagcttcaccgccttcaacgccttgcgcagattgccggtcttggactcgaccagcatggtcttcgcgtcatggccgaccaccatgaaggtggtgcggtgcgcgcgttgcacggcctcgacctgcagtccgtcgcggtaggctcccgtatccacgggcgcgttggccttggccacgccgagcgccttttcggcggctccacgggtcagggccctgactccggccgagttgaggatctggtcgaagaacgcgtcgttgaacttgatgctggtctgtccgcttccggccatcggctaccccttccactcggtgagctggacttccaatgtgggctgccagccggtaaaggcgttgacatcgcggctggggaagccgctgacctcccacatgcggccatcggccggttcgggtcggatacggtcaccaatccggatgtccgcgttcgggtcggccacggtgagcaccgcagtcgacgtggtctgcacgtccaaaacgtcgggcgtgcgagtcgaactgctcgaagccaaagctcctcgcacttccaattcgacgggtttcgtccagtcctcggtggtctgcgcgggattgtacgggtcgggtttgcgcgaggcgcgcagacgcacgaaccgtgtggccgcaggcaggccggaggcgttgatgtcatcgatgatgctcacggcaacgctcccagcttgtaccggtcgagtttcgccagctcgtcggtcatcagggtcacgttgtaggtgacgctgatgccgttgaccgactgggattggacgatgccggcggctgcgctgctggcccgtttcgccgcgttgatgagcaccccctgcacatccggcacctcgtccggcgcataaccggcgtggatgcggtagcgtatcgcggccacgccggccggaaaaacgccggcggtgcattccaccaaacccgtggcggggtcgtaggcgtagtgcagccggttgccggcgatatcggtcagctcatccaccgacgtgacatggcgtgcggggaggcgaatcacctttcctccccgcgaattgaccacgcccgacagttcgatgttcggcgtgatatgccagccgcacgtgcggcggatggccgcctgcgccgccttgatccaaaaggatccgtccgcgtcgaacaaggacggatcctggatcatgtcggggattgcctccgtggaggatacgacgctcatagcccctcgctttcgatggttgcgatgctcgggtctgcgattcgggcgacgaactcctgtgacgcttcggctgggaggactgacacctcgagtctcgccgtctccccgaccctcatcgcgagggcgtcgggtttgacggcgatgctctcggcgtcaggcgtcacttcgctgcttttcccagtgcgaccttgacgaaagccttggggtacttgacctgcaggccgatgcgttcgcgcacgcggaacgtgatgaggtcgttggtgaaatcatcggagtgggagttggtggactcggcgcgcagaccgcccttgcggatcactgcgccgccgagcttgaacgcgccgaccaggacggtgccctgggcgatggcctcggtgaccacggtcttgagaccccacagcggcgggtcctgcatgatggtgccgttgccgtactggccgccgaagtagccgccgccgtagtactggccgttcgaatccttgctcaggcggatggtctcgtagtcggcggggttgatgacgatggcgtcggcgcggaagccggtggccagcgcgatcttggtgcgggccttgaagatgcggtcagggtcggaatcagccgcctgcgccatcgtctggatgtcgcgggtgagcaggcccttgacgttcgcgctggtgccgtcgccggacagcagctgggtctcttccagcagctgcaggttgtagcgggcgtggttgttgatttcggagacgatgtaggagaggtcttcggccatattgtcggtgaccttccaccaggtggcgacctccttgagactgtcggactcccagctgggggccggcagatgggtctgcggcttcgcgccgccctcgcccacggttcccgagccgccctcgagcgcgccatacaccgggtattccacggtgttggcattgccgctcagggtgacggagccgaacaggtcggcgaccacgagcggacgctcatacggccagacgccgtccatgtcgacctgcgtgaccaccggaccgtaaccggtgcccgcagtgccggtgcccgccacgtgagtgtcggtcgcggccttgaactcgctggaagcgaacgggtgcgccttggtgccgatgacggtcatgccggccttcttcagctcctgcgcgtacagatcgccaagcgtcttggcggcgggagccgccttggcctgaggcttggcctcgtccacgttcaggtcgttgacgcctttgaacaggtcgacgcgctcctgcaaacgcttggcctcctcgtaatggttcttgagttcggtagcctcatcttcggtgaggttctccatgcccttgtcgtacagggccttgaccgccttcttctcggcggccagcttctccatgtaacccatggatcatcctttctattggttgtttgccagcgagaggaagtcgctgatttccttggcccactgcgggtcaaaactctttttcgccttgccgtcttccggctcgggcttgtccgaatcgtccggcgtatcgtcgtccggctcgtcatcgggcttggaatcgtcgtggtcgtcatcgtcgggggtttcggtgattgcgtcgagcagttcttcgagcgcgtcgtaggctgtgcgaatcttgtcctcgttggccttgctgatggcccggccggccttgacctcgagcacttcggccccttggttggcggcgacctgcacgagactgatttcgaacagtttgagctggcgaatctcccggtagccgtcccatgggctcttcgattcctcgtcctcgacccacgcggtcttttcggcgatgaaaccgatgctcatctggtggatgaggccacgcttgagcaggtcataggctctcttgccctccgcaatgtcggtatccaatttcgcggtgatgagcaggccatgctcatcctccacggcggagagcgtttcgccgatcacatcgttgggcgagccgtccttgtgttgccagtggatggggatgcccgcaccgccgttcttgaagtcggcggataaggtctgctcgaaggcgcccttgaccaccacgtcgtcgtacaggtctttatcccacgtggatgcgtagccggagaacacgcctccgccactgttgtcggtggccttgagctccttgagctcgtagccgagataatcaagactcatctgaggtttctcccttcgtcatcgagtcccatgacgcgcggaaaccggcgtcatacgtgtagaggcgtttgaattcggcgagcatctgcttgccgttcgggcttgcgccctgttgcgcgttctgggtctggccgccgtcctgcgggctgggctggcctccctcgctcacgttgagcggggttatcagctggtcgccgcccggcagtttcggacggtcgagcagttcgcgcgcttcgtccgtggtcataaatggacggcctgtggcggtggagagcgcctgatactgggtttccatcgtgccgcgcagcttcgcgtccaaattcgccttgatgtagcagtccggttcgccaaccgcctcgggaagcgtgaggttcaaagcctcctcgaacgccaccaaatacggcagcaactccacgttccagagtttctctttgtaggcgctgatgttgctgttagtgccggtgcggaagccgatgttttccggcgagatctggaatgcgagacacacctgttcgttgattttctcgcgtgcctccaagtcggccatgtcgacaggcttgaacaggttctcgatggtgcggatctccatgccgtccttgaatacaggccatgtgccggccatgccgccgccggccacgtagttgcgcaagccttgggtgaagtcgtcgtagtcggcctgcgattcccagggcatttccttgggccggtatacgtaggcgggtatctggtagccgttttcggctatcgatttgcggtatttcgccatcgcccttgcctccgcgagcagtgggcgcagcacattggtgatcgggtcgcctaggttcaggccgtcgatgtagccgatgtcgagcacgattcgcgggtccggcaggcgataggtgccgcccttgttgccgtcgacgctgctgatggtcacgcttgtcagttcgccgaaaccgttcgccgtgagactgtagccgtccgtggggatgcggcgcagcgtgttcccgtcgcccgctcggtcggtgccgagcgtgcacagccatcggtcctcgagcagcatgtcgcggataagcgtcagatagaaccggtagcggctcatgcccggcaattcgctcggatggcggatgagcttggccagtgcgccgtcgcgcacctcttccgcgtcgccgtccgcgttcttccgatacaccttgagcggcagggaggcgagttggcggctgatgaagtccacgaccacgcggaccgcgtattcgcggcagtacatgccgtttgcgtatccggcgaattcggcgtcggtgggccagctgatggcctcgggcatcgaatccttgatggtcggagtctccggctcggcggtcttcatcgccagcacggccgggccgtgcagcagattattcagaaatcccatccacggctccttcgaatttgagagatggctagaatgtgaccctcacgttgtgtgagggttcgtatttcggtttctcgggctcgccgctcatcgtctcgagcgcatacaaagcctgtgattcggcgatgaggccggaaatgtgcatcgcgctctggttcctgtcccacacctcgacctcacccaatcggcgggtcacggcgacgctcacctgctgttcgatggcgggctgggggagatgacggagtttgttttccttaactcggtcacggaaacgaccggtggcggctcccatgcggaagccctcgatgagatgcaccgtccaacccgcctccgcgagcgggtctgcgaaatccaccgccggacagcctttcgactgcacggcgatttcgtggatgttcggccaagcctcgcgaagcattttgaggtatttaggcacccagagcatgccgtcgcggcgcacgatcaattcgacgtgcggcaatccgtcctcgcggtagcctgcggcggcgatatacgtggtctcacggtccgcgctggtgtccacggagagcaccacgcgcccgtcatctgggatacaagacttcgggtcgataccacgcttccacagtttcgggtcgatgtacggcgtgatgtcggcggtcacccactggcacaaaacctcggtgcgatacgcggcctcggtcataccgttgatgtcagccgagatgctacgaaaagtcatcggcccataacccatggaggggttcgcctgacggataccggcaaggtcatccagctcgcatttatccggagccgaccattcgaaatacccataggatgggtcgtgctcctcggcccattcgtccggcgactgcttgccggtttcaaccgaagcgttccacgaatccgccagggcgcgcccttcgtcgacgactcggcgcagcacgacgctgcgatagtcgccggcgttcgagatgccccacaactggctggaccagatggccttcgtggtctgcgataccgcattccagccatcgtcggtgtgctgctctcgcaactcgtcgaacacgacgcggctggcgctcttggaacggatgttcttgtcggctcgcacgatgtactgcgccttgtttcggcagatgatcgcttcctcgccatgcgaattgttgacgcgctgcacacgtttttgcaaaaccggaaccgcaagagcggcctcgccctcggaagccggattcggattgcaccagttcagcacggcctgatacggtgcgcgcgcgttatccaacgtctgcgcggcaccgaccacgagaaacttccacgccggcgacaattccgggtggcgagtggagtcgacgaacagccaccacgcgcacagcacgctcatcaccgtggtcttgccgttctgacgcgcgacctcggtaaccactcggcggaaccggtaggagccgtccggcagaagctcaagcccgtggatcagcagccatttctgccacgggtaaagatgcacgtggagaaacttttcggcgaactcgatgaccgcgtagccgtttgatgtcgccggcgtcagttcgcgcagcgggggagtgaatatgcgcggcgtggtgatgccatgggcatcgtcgtcgatttcgccgatgcccatgacgcctcctagctgattttcgccaaatactcctcaagctcatccgccaccggagtcgcctcgggcttggcggccttgcccctcgccggcttcgccggcttctcctcctcgggaaccagtccgagagccgcgcagtatttcaggaacgtcggcagcgaggtattgtcgttctgcggcacagccggacgggcaccctttcccttcgcttcggcgtccgatatggcctgttccgccaattcgtcccaatggtcgattttccatgcaagggcccgggcggcggcgaccgtggctgcgtccttcgcgcgcagatgcttggcgttgcgcagcgaacgctccaatgcgtcggccaccgtttcctgcggaaactgtttcggcatggaacctccttcgcgcgcgaccccggccgaatatcgaataattttcggagggagaggaagagcggccatgcgggtagtgttccgttggcggctggttttgggattttaccgcccctcccggttggttaggctttgatgactgtgcggagtacttcacattcgatgtctccgttatgtattcccgtgatgcggcagatgcgtgtggcgttgctatcctcgatgaggactgttctgccgcgcatgggttcgtcgagacattggctggcgaattcgtaagcgtctggattgatgtctatgtctgctttggtggtgctcatgctgttttgatccattgtcttgagagtgtgccgattggtgtggctgggtctttgttgccgcgaaggttgttgcattgggtgtggctggggcggaagcctgcggggtcgtgttgcaggtctggcctcttagttactgggtagaagtggtcgaggttgtatgagtcgtctgtggtgttttggggtgcgtcgtagtcgatgggcattccgcagagccagcatgggcggtggttggctttgcattcgttaaagaaggctttgcggtctttttcgaattgtcttccgcctttgcggacttgtcgactgtagctgaccatgttgcagtcacctcgcattgcggatgttttgtgtggcatacgcggttggcttcgatccaacgacctgcggttttggagaccgctgttctacctgctgagctacgcgcataggtggtcatgccggttgagtgtcatgtcgcatgaccgtgtgtgggtatgagtaaagccccagaagacgtatcctctgaggctttcacagtaatcctgatacggagtataccacggggtggcggcagcctactcctgtctgaaatcttgtttgacgggaatgttggcgatgtatccggcctcacgcgcttgattgatccagcggccggctgttgccttgctgatgtgcatgaggttagccactgtctcgtgtacgtcagaccgacgcaacgtagcgttccatggccttccgccccagttcggtcagcccgtcgcggtcaatcaagctcctgttgaacatatcccgataaaacgggtcgtccgggtcatactccagaagacgctccttctgcgggtcgcggaggaacctttcaaggcgttcgcattcgtaaggggataaatccattgcaatcgggtcggctttgatgaggtcgcgcagtcggtttgccgcatcctcgtattccgctttccttccggccagcttgtcggggagaggcatctcggcatcctggccgtcgagattcctgcgaagatgcgtccaggatttcgtgatgttgtccgctttcagcatgtagccgcgagcgaggtccaaaagcaggttcatccgaaaccacgcgaaggcatcgggatacgaattccacctcatgtgaatcacgccgtccatgccgacccatgcgaaacagcgacacggctcgtatacgttaatggtcatcgccgcatcctcgtaatcgcttttcgtttcggcgtccgcatccttgatggacatttcgattccgaggtcatgcaaggtgttttgaaggtcgcgcagttccttcagtgtcttctcgattttcagcatttttcgtatctccctatgctttctattgacttccttccccgcctgaaggcgggggattcctactccggtcggcttattgacgaaggcgatggtgtccatggggcagcacgcatccttgatgatgtcgttaccggtcgtgtgcgtcgccgtcgccgtagcgtgccgcaacatagattcgagcgaggctcttcagttcggcatcgttaagtccgcgacgatggtttcttcgtggaagtggtttgaactgccaccattcatatcgcgtcgggcttaatttgtgcaggatatgttttccgatggcggttcttttcagcttatttgggcgtagacgcccgatggtgccggagttgatgttgccgtctcggcttttgatttcgattttcgtcagacggtgttctgcgctggcggagtcccagtgaattgtcacggatacgctgagcccgtcatattccgtgggcatgtcatattccgcgaagtcattgggcagatataggtcggctccgatgtgatgcagtttttcggtggtcatattgtctcttatcggttgtttcggctcatggcgaaggatacgatttcgcggatgttgaattcccagtaaccgttttcgacgggtttgctgctaggtagtttgccgcgtctcaatgcgtcggtgatggtcttgcggctgacctcgtatccgtagttttcgcgcagccattcgctcatgcctgccggtgtcttggtcaggtggatggtttcggccttggcttggctttgttcgcgtagctcggccacgttgatggggttgccgcatttgcacagcagcagcgattcgcccttcgcggccatgacctcgcgtccgcattcggggcatacaccgatgatacgacgtgtgcgtggctgacggtcaacgagtggttcgatgcgttgggtcattttgatgagctggcggaggaatcgtcccgcgttgtgtgcccggcatagccatgcgaggtgggtttgcatgcgggggatgaggcgttgccatttgtcgctccacacggctccggcgtcgcaccatgcgtcctgcaacaatgattcggcttcgtccagcaggtcgatggcgtgcacgttgactggcgcgggtgcctcgccgcctgatggcttgcccccgtcgccgggttcgccgagcttgtactcatgccgtgcgacgcgctgcaacagttgcatgttgcggcgcagctggtggagtgttttcgcgtaccggcggcggcagtcctggcatagcgtccacggtgcttcgacctgctggctgccgcagtattggcatggtttggtggtgatggacattgtttgaaaacctccacgtctcggctatgattgtgctttggtgagcgtgccctccgccttgtggtggagggtttcgttttattcggtgtcgcgggtcatgcctcgaacagcggaggttcgatgaattcgactttgcgtggtggtttcggtcgtccgtcgccattgcggatgatcgcgcgtactgcctccaacggcaggcccaattgacgggccgtctccgttgcgctgtagccgcgtgcgtgccatacgagcaccttgtcgcggattgtctgactggtcatttcacgcctccagtatgtgggtcgatgagctggcagctcatggcgtcgatgcgcccatcggtcttggcctcgatgcagaggcgtttcacgtcgcctgtggtttctacccgttggatgatggtctgctccggctgtacgggtgtctgcgtggcagtccagcagacgaatccgatggccaccatgccggacaccacgatcagcgtcaggcaggcgagcatcgccagtccaacgaaattctccaaatcccagtcagcaaacggtttcctcattcctccacctcggtttccgtgccgtaatggtcgtagatgtagtcacccatcgcattgatgttgattggccgattgacgctgtacaggtattcgtgcaggccttgtttcagttctttgcgggtgaatatcttcgccttatagctcatcgtctacctccatttgtttgtccagccatttgttgagaagaacgtgggccgcatcgcgtcgggctttgtcgcgtcggctttggtatccgttccgatgccggacgcattcggcgcaggcccgccgcgtctcatcgatgaacacgttgcgccgtgagtcccaacgcttgatgtccaccgatgagctatcgccgtgcaacggtttacgacacaagtagcagtcactcatcgtccgcctgccttgcatcggggtttatcgtgtcatccctgtatggggtggtcacgccaccgcagccgggacaatagccgaaatccggtttgatgcggttgccctggatggtgaaccagtcacggctcatggactgtccgcatcgagagcagtcgaagccgctgtccgggtcgatgaaactcggcccgttcacatcctccgggttctcgatggtcgtgtccgggcggaatacgactcgctggtgaatcacgagcgtggccatatcgggcaacggcgcactcttcttgcggtccttgagcttcttgcgatactcgtaaaccttttggcgcggcactccggcgcgctccgcgatctgcttcggcgtcaactcatcctcagagataagcctcagaagcgtgtccaacgtctcagccgaaagtcggcgatactggcgggttccgctcatcgtctgactcccatctgtccttccgcgagtgcgatttccctttcctgccagcgggcgagcatttcaggggtcgcgttgcgcggcaccggattcgggtctaacgccttgccgtcgcgttccttgtcggccttggcccacttgcgggcgagtttgcggcgttccttccatgtcagcgtcacatgcacgtccaccaccctgaccaccttcagccggtcgcaccggtaggattcgacggaatcctcgccgctgcgggtgagcgtgcaatcggccggtcgcacttggtagacgttcccgcgcccgtacatgctcgcgtggaagcgcgcgtagagacggtcgggggtgcagtacacctggtcggggtgcagtgtcgcgtcgatgggtgcgtccgcgccctgctcgcgtcgggcgcggcatatcgggcagtcgtcgaagttgtcccggctgtggccgggctcgatgatgtcgccgggtttcaggtctggaactccaccgtggtatagcacgctcatttcatatccccttgcaagtcggtcggttcgtggtctgtgtggaatgcgtcgctcatgcgctcatctccttgaggatgttcacggctttcactccattggctagatgcttctcaccggcattcacgctgatgattaccggctggtatacgccttcgaccgtcaatgattcgcggattccttccgtcgcgcctcgtagttccttacggagcttcgacggcacatgttccagatacccgtcgatgatcgtgccctcgtcgagttggactatcgccctatgcccggcgagcatgttcgcggcctcgagcagccattgcatcgcccgctcctgcggggtcgggaacttttctgccatcacgcgcctcccagcatcgagccgagcgaggccatgccgggtcgtgaggcacccgcgaaacggctggccgtggaacgtgacttcggctgcgcggcgggcagttcgaaggggttgcgcatggtcaacgcctgctgctgcgcctgatccgggccgttgccgagcatccgctgcctgcggtacagccacgcctgatcttccaccagtcccaaacgttcgcactcccggcctatctgcgcctccgagggcttcgactcgttgcgcatcctgcgcacgatcgcgttcacatcgcccgaaccgcaccagcggcccgaatcgttgtccgcgtagaagcgcttcaccgcctccaacgcctctcccagcgtcatgtccgcgcgaagctcctcgtggaacgtgcgcgcctccaagtcggtgatggccgcgttgccgtggtggacgcgaatcttcgccagcacgagcgtgctttccttgagcgtcagcatgtcaggactccttcccgtgattggttttcggcggcttcctcggccgcgtagtgggctatcagcgccgcgttcgcgtcctggttggcctgcgaacggttccacgccgatggcgaggggcgtgcggtcggctcgggtttggccggcagcgggtcatcgtcccagtgttcgccgtccagccagttcgccggggtgagcgtgtagccgggttcccggttcgggtcggcggcgtacatcgacgccttggcgatcaggaacgtgttgttggttttcctccgcgccttccgccaagccgcgaaggccttgcgtttgccggccttacgcggataggtcgtccagaactgctcgaactcgatgggataatcctcgtcggctcgctcttgcggggccggttcggcctcgcgcgtttccctgttacctgatacctgattacctgatacctgattagagcggaagatttcgggggattaccgtaatcttccgtaatcttcgggggattaccgtaatcttccgtaatcttcggaagtgtttgggaatcggcttcaggacgcggaaaacgaggcttcgccgggtggcttatcttctgatggcgatcccagttcgtcaaaaacagcagactgaccgtcttgccgtcgatgtcggcctcgtacaatgtcaccatgccacgcttctgcatttctccaagactttcagtaatcttctgaaaagttccggcagggtcgtcggcaaggcgtttgcggaacacgtcggcggcgatgtccagcacattgttctttcccacgccgttgtcatccacgtagttgatgagaccaacccacatgagctggccgaaatcggacagtgagatgaaatcgtcactgctccacatctccggtttgatgatcctcatgcgcatccgtatcaccctccatccgtttacgtaagtcaatggccaccccgtcaaggaggttgccgatgattccactcgcataattgaatgccttgtaacgaggcagtcgcttcatgtcgcatttctcgcgcgctatttcgaacgcatagcgcaggtattcgtcagggacatcgatatgcgcccagtatctggccgaacttctccatgaatcaggcaacgggaagcaatgctcatcatcaagcgaggtaatcgattcccacatatccagaacgttgtcgcagtatgcacgctcgtcttcgaggctgactctcttatcctcgatggcgattttcagtagcctgtggaatcgagtggcctcttcggacacttgcgccaccaacggttcatcggggttgatggatgatttgccgctgttgcactccatgcagcaggcaactaggttttcggcttcatctcgacctccgagcgcctgaggcactacatggtcaacggtcagcggaatgtctttgcaatggcaatagtggcatgcgtagccgtctcgtctcagtacctcaaaccgtaacctcttattcacggccatcagtccgcctcctttctcgtgcctctttggtattcggctatcagtgccagcagttcggggctggcggcgattatctcgctgggcttcagccccatcccgtccccgttggtcttgggtttgcggtggtagccgccacgcaaaccggtgcgacggctaccaccgatgtaggtatgagggttaatcctggccatcgtccggccccaacgccaagccgtcgttcagcaggagcgcgaacaattcgagcggcatccacacgagcatcggattggagggcaccggcctcgattcgccgcgcagccggttcgcgagctcgcggcgaatccggtagtccggtcctaacacgtgccccatgtgagtggcgaggaaccgttcgagcgttccgatgtcgaacacggccatctgccgggccatgcccttgaggcttttcacgcccacgcccttgcgatgctggatgagcaccccgtagggagtgtccatgttcgccatctccactttgagctcccgccagtgcttgcgatagttcggcatcttcgtgtccttgcattccacgcacaccggctcgccatggaacatgacgccgatcagatcgccctggtcggcgttgccatgcaacggcatacggtcgatgcgcgtgtcctgcaacgcccacgcaaggtaacgcaccgtccacgtctcaaggctcgtgcctttgcttttacttggattcgccatcatcgctccaatccgtattcttcgactatttcgtcggcttcctccgcgcactgcgggcatgggatcggccttgccggatacacggggcatccgtgagtagggcagacaggttccacgtccggcggcgtctcatcgtgatacaaatgcaacatgtcagaactccggggcgctgccgccgttggcccacgggtctgaggccggtggctgcgacggctggtatccgccctgcggctgctgcgtgtagccgccctgagcgccgtagccctgcgactgtccgccgcccttctgcctcacgttcgtgatggcgaccgccgaggcgctgaccgaacaggatgcggcaagcccgccatttttgttcgtgtaggcgtcgcagccgctgacctctccaacgatggtcacgtccacgaactggtcctgattctgacgcagctgggcgatctggtcgaacacggggttgaggttcgcgtagcccgcaggccacaccgagtagtactgttccggctggcttttccagttgccgttccggtcacggtagccgggcgacaccgatacgctcagataccttttgccgttctgcgtttctcgcacgccccacgccgtgccctggatgatgatggtcgctttccccgccatggtcactcaccttccttcacgccggccttcaactggccgatcaccttgtcaagctcagcctccgacagttcgtcgctggctttcacttcgcggttcagaatcttcgagatggtctcgcacgcctccgcgtccgaagccacgcccaacgcctggaagcgtcgaatcatctcagaacgcttcgcctcgacgggagacggctgcggctgttccggttcctcgggttcgtccacgctcacgtcaaccggcgaatcgtccgcagtcacggtgggcagtggacggaacacgtcggaataatccggtgtctggtcgtcgcttgcggccgcgtcgcgggcctccacgctgaccggcaggtaggggaacgcgcggcggattaccgtcttcttcgccatggcctcatagtcggacttccacgggctgaccgccttgccgtagctggggctgcgtttcgccgccgcctcgatctcgtcggcgttcatcacctggaagtaatgcccgccgtccttgaagttcgcgatcatgtacacatgggtgagcttgccgggcttcgcgcacggcacgtgccgcaggtcctcgttcaggccatagctgtaggtgaattcgtcgccctcatggactgctcgggcgctgatgtccctgatctggccgctgcggcgtgcgaggtcgagcatgcccttgtaaccgatgatgagtgtggcttccttctgtccggtgcggtagttcttgttcccgtagggcaggatgtaggcgcgtcccaatccgtccacgttcgacggttccaagcccaatgcggcgcatttcatgaagcaggacagcaccgattccacgccgcagttggcgagctgcggttcgcggttgatggtgctcacgtacatctggtagaggcgttgcgggctgaggttgttgccgatgacggccgcgatgcgcggccagctcctctccagcaggctcttcatgttcttctgcgggttcatcgtctgcatctgcgcgttctgcgcctgcgtcgctaactgtcccatatcggttctccttacttggttttgagttgggtgatggtgaatcgtctctggtcgtatgcgggtttcgcctcgatcgctggcttctccttgtagtggacggtccggtatccggccttccagccgccgctgatcaggccctcgcgttctgcgccgaccatcgccttcaattggtcggcgatcttctccttcgctttcttggcgttggattcggcctgcgcgtacgtggagtacatggcggcgaggtcgtcgaattcatggtccacgacctgctcgtagccgtccgggtagggtggcatggattgcgccttgtccacgtccgcgccggtgagctgcggcatttcgtcacgctgcacgtagccccagaaatcctccgccgcgtggatgaccgcgttgatgtcgtcatcgtcacgttcgaagcgcacctcgaccggctcgctttcgccgatgtccgcgtagaaatacccccagcggaagccggtgacggccatgtaatgcgtgacctgagccatgtagtaggcgggggcggtaagctcgccatcgccgtcgtgccagtcggtgcgcccacggttcgcgttcgcggtcttgatctccagcacgccgaacgaatccgattcggagtcgtagaggaaaccgtccagcgaggcgtgcatcaacggatgctccttggacacgaggctgatgtcggtgccgtcgatgacctggtactccgggtgcagttggcggaatcggcggcgcagttcgatctccaaggcgttgcccttgacgatcgcccacttgccgctgatgtcctccggctgctgacggcccgtcttctccaaccacagctcgtaaggggtcgagtattggttgaggccgaggatcgtgctcatgtccgagccgccgacgcccagtgcgcggaacttgcgccacgcactctcacgatccgtcttcgtgcgctggcggaaacggtgcacgtcgaacagtccggtcgccttcgctgccatgtcaacggtcactcgtttcattgctgctccttagcttcgatttgctgacatattccactcgtgcactcaccctgcgccgttgcctgtcgatgacgaccatgcccggcaacggcatcacgtacaggtacgggttgccggtctgactgttccggtcgctgataagatccataaactccacgatcaattcgcccggcgtcatgcgcacgccatcgtccgtgatcggactccacagttccaccgtgtccgtcatccatatcctctcgtagtccgacgagccgtagcccggcctcgtggacgctcagtccgatgaggctcgcgaggctttgccgtgtggggtgcgcggtaaggatgtcaaggtttttgagcagcttcccggcgaccgccagccacatgtcgttaggcagatcagtcatacaggtattgcttgcgggtgcgttggttgcgctggtcaaaacggttcacctcctcgacgcggaagccgagcacctgtcccgtgtccgggtccaataccggcactggcccccagcctcgggtgagcttgttctgaatggtcttcttcgcccgcccgtagtgttcggcgagctgggccacactcatgaggttcggtgtttctacgctcatggggttatcctttctattggagatcctttcttcgcccccgtgccagcgggggttttcttttttttaacctttcggtcgtggacggccacgcatcgaagcgtgatcccggtctttgccgcgcacacctgacctacgcgatcttgactggggggcaacctgcgccgcccgtggcatcggcccgagaagcaaacggtggtaacaaggccgacgccggttcaaaaaacagacacagtatctgttttggttttttcggttatcacgagggtttgcggttttccttccgattgtcagccggttttccacgccgaccggcaagacagttattcgtattcgacgccagcctcgctcaacaccagatcgatcagtcggagcggcacgaaaccgaagccaatgagcgcggcgatgccgttttcgatgggatgcgcgcaccccatgtgagtcatcatccagccgacgcacaccgcgtacgcgacgatccagagcacgagacggtgcatgaaaccttgggacggctcgcactcgtcggacctgcgatagccgctgaagtgatggccgtaatccttggcgttcatggtttgactcacttgggttggatgagggtgttggatccctcgggggtgacaaccagctggtcggcattctgcaatgcgtcgatgtagtgctgtctgagcacgttgtcggtcagggagtcgttgagcaccttgttggcgtcggcctcgccctgcgccttgatgcgtttggtctcggccttggtcttctcgacttcctgctcgttcaatgccttctgcttgtcgatctcggcggcctgtgcctccgcgtacttcgaggtgatggacttggggtagcggatctcctgcacactgacctgttcgacgcgcagacccatgtccttccatttcgcggtcagggccttctggatggcggcggtgtacttgctgcgatcggtcaatagttggatggtgtcgaattggccggagacctcgcggggcacgctgcgcacgtcgactgctgccaccgatttcacgaatgtggtctgcttgccgtagtccttgtacaggtccatcgcgtacttcgggtcgagcgaatagttgacctggatgtcaatgtcggcctgtgcgccgttcttgtcgttgacggtgacctgcgggcctcgtgccgagcctccgtcgtagtcctcctcgcccttggccacatagctgatgacgttgttgcgggtgtcgtattgcatggtggactgccacgggagcttgccatggaatcccgcgtcggcggaatatccggcgatggagccgcccatgttcttcagcacgacgacctctcccgcatcctgcgagtacaggcaggcgggaatcatcagcagaccagcgacgacgatggggatgaagccgaggcccgcgccggcgctgccgccggcaagggcgacggcgacggcgccgaccccgatgagcaggaggatgattgcgatgacgaaccagaccatgatgtttcctttctctggttttttacgggtcgattcgcttccctctaagctggatattgcctaactactagctatgggaggaagtcaaaaatgaccaatcgtttgcatttgggctatggggagtctctactggcgtagccgttcctcgattcgttccataaggctttcgtcgtgcgccatcacataccccgtaaggtgcacggcgattgccccgccaaccaacagcaaagttgcgccatacccgataaatcgaacggccaatctatatgcatcgcggactttcatcacgtcaccgccttcccacagaggaacaggttcacgaaaaacgcctgacccttgcccgtcaccttcgtggtcttattcaccgtgatatgaccgtccgaatgggtgatctccgtttccttgatgcggaataagcccaattccatgctcttctgcgtcggcatgttccggctgctgcccgtcttcatgagccaaccgttctcgcgcagccacgcgaacaggcgcgtaccgcccatgtcaatcccattgcccttgagtatcttcgccagctcgccaaccagaatgtccgtcttactggcgctcaccgcatccgcgaacaggaccttcggagcttgtgcctctagctgccttttctgttcgtcgacttttgatctaagccagttcatcgccgccaaggtcatctgttccggcgtcattgattcctgtccggccatgtagccgccgtgtttgcggatagagggcaggacttcgtgcgttacccaacgctggaactctttagcctcctgtttgcggctgcgcatgatcaacttgtacaaacccggctcggagacgatcaggggagcacgaccgccattcttcccaacctcccaattggggaggttggttgcctcagtgatttcgtcagagtcaagatcacgccgaagatgattggtctccactgctaggatgtcgcaggcgtccttggcgacgaaccacggctcgccatgcgcgtcgatcatcgagcggagttggttgttcttaaatttgaaaatctggatttcaggcatgagataccttcttgccagcgagcgcggtggccaaggtcttgaccgggtctccgcccgataactgctgtgcggccacgaacgcggcgaggctcatgtcgtcgccgtcgagccatttggcgatggtcatgcggttgcggttgctggcgtcggcgatgctggttatcttggtcttggacagcagcacgcggttgcgggtgtcatgggtcgcccgttttgcgacttcaattgctggtagattagacatgtgcaacttctttcgaagaggaggggaaaatgaacgctgcggagtttctgtatgatttcttcgacaaggaaagtgtttatgatgccgaccaagccggataccgtttccctgatctggtcgccgctctcgatgaaatcgggaaagcgactgaccagtgggaaagggaaggacgacgcgtcaaaggatttcgctcttctctgcctcggtggcgtaaatccgtgacgatggcgttcacggataccggcgagattcgttgggatgagatcagcggccccgttggcacgtccgatttcatgtccgacgccgacaaggacttgttgatgtacgcggctgagctgcttgattcatgcacgcttcggttcaccgaagagcaacggaacaatgtcaggaatctcgtcagcgaggccaacactgtcctcagaggaatcgcggacggcatgcccgatggtctggccttgtacctgtcacggcttctgagagaaacagagaccgcattggacgagtacgccatcacgggcgatttcgtgcttgaccgagcagtgagccgtttgcgtgaggcgttggacattgccatggtgcagacccccgaagataagcagtcgatgtgggataaagtcaaggatttaggtaagcagctggctatcgggtacatgattgaggctccggctcttgctctgaccgccgcccagatgtttccgccccagatcggcggttgacctcggtaaggatgttgttggataccgtcacctcgtatttgtcgatggcatccttggtcaacgtgccttcacggagcatgcggcgtatgtccttgcagaaacccatcacgaggttcatatacaagtgcagttccttggtcgaaagctgtctgaaatcagttgaggacatctcaaccacctccagtatgtaagcttgtgattactgaaaagtaatgttagctaacgcttacaatttaagcaagtgcggcgtgtctccatgtgcttacacgtatgtttgagccatggcagcaaagattgaatggacggcaatggattacgccgcaaaagatgccttggcgaagataattgatgattccgccttggcgtatagagtgattgccgaacgcatgggtggtgtggtcagccatgtccgagtcggatatattcacaacggcgagaagtcacccgttcgtctttctgaatttttggcgatctgtgatgtgtgcaatgccgacccggtgcagacgttgcgggacatcatcgccgaggccagccgcatcgaggcggaacgcgccgccgacgagatggccgaccgcatcgccgccaacccagaacagttcgacgtagccgcgaacgacgacccaaacaaggaaaacgaagccaccacaccacgcgaatagaggctttatgggatatgaggatctactcgccgaagcctcacgcctcggcgtcaaagtccgggaacgagaactatcgcccggacgctgcggctgctactacgaacccacgcgactcatcatcatcgacgagacgctcccagacttcgcccggcgttgcacgctcgcccacgagcttgctcacgccaggcaccacgatcgaggctgcgacccgaacgggtcaaaagccgagagacgagccagacgcgaaaccgcgctccgactcatcaacccggccgaatacgccttggcggaacgaatgtacgacggcaacccctatcagatggccgccgaactcaacgtgaccgtccaagtcatagaggattacaagaactggctgcacgacagtgtggccgcatagggtgaagaaagcttatgtttggttttctcaaaaacgtgtcgcgtggaccagcagctaatatggcgaatattgccgttccgcccacactgcagaacgtgatgaccggacccgttgagtacaaagtctacgtgtacgacaataggccgcttcttcgcatccctcccgggcacaggttcctcacgggcatagtcaggcagcggacaatactcacgagcggcctcaccgatactgagtacgacaccgcagacggcggatatgcgctcgcgtacaatggggcgatattcggcgtgctgtcctcatggaagttctgcgattatctggaccgctacggattcgcgtacatcgaatgcgtgtggaaccagtggtacgacttcccgcaccggttcccgctcgtcgtggccctaggccgcgaactgaagaatggggccgacataggagccgtctttcataaaaccgtcggcaagcattctcccgtaatagaacgtcttctgaatggcatcccggaagcgacattgccggccgaagtcatagctctaccggtcccaaaaggctcgcaggcgaagccccatgtggcaatcaccgttggtggcgagacgatatgcgaaatcggcgcacgctcgtgggattacacgaatcttgcgtctcttgtcggaatgagaggaggcgtgagacttcagcgatgggtgtcccgatatgaggatgatgacgatggctactattacgtgatagatctcatcagataagaatttgccctgccggcgttgcagcgtcggcagggctgactctataatctgttttcttccgttttgggctcattgagaacagattccgattgtctatatatcgatttccggcgttttcgatacatagaagagtaatattcgtattccaaacatcgatacaacgcgaaacgaggtgataggggagatggactacaaaagcatccggcagaccatcaacatgtcccggtccacggagaaacccacggacgccgcccaacgcgaatacgagtcacgggtcaacggatggtccacgttccgttccggaatcacgttcgacggacacgagatgttcgccgtatgcttcagggaactcggcacggccctcgacaccgtgagggaactcgaaggaagcgtcgaatcattgtggaacgacctgccgaacatcgccaaacgggcctacctgttcgacctcatcggagccgaggtgcaaagcaccaacaccatcgaaggcgtgcacaccacacgcaaggagatagccgacgcactggaatcggccgcgggcgagggcccccacaaacggctgaccgaattcgcgaaactgttcctcggactgtccggagaggacagcaaacagctcgaactgccccacgagctcaaggacatcaggaacatctacgaccaggccaccgacggcgagatagccgacaaggacaaaccggacggcatactgttccgaaagggaacggtctccgtgtgggacgacggcaacgggcgcaaactccacgacggcgcataccccgaatcggagatccaggtgcaactcaccaaatggataaccctgctcaccgactcgaacataccgccggtgctccgggccgtgatgtgccactacgccttcgaatacatccacccgttctacgacggcaacggaaggacggggcgattcctgctggcattgcagctgagcaagcatctgagcgtgcccaccgcgatatcgctcagccccgtcatagccgacgccaaaggtcagtactacaaggcgttcgacgacgcccagttcccgttgaactgctccgacgtgtccctgttctgctaccggatggtgaagttcatcatcaccgcgcagaaaaacatcatctccgatctggggaacaaatggggctccctgaaggccgcctacgacaagctcaacgactacgccgaacagaaacgcctgtccggcgaccagaaggacatcctgttctacctgcttcagattgaactgttcgacaacaacccgcaaccggcatctcgcaaggaactgtgctcgttgctcgaagccgggaacaccaggctcatgagctccatcaacgcgctcctcggcctcggcctcctgcaggaacacggcaaacggccgatacggtattcattgtcagaaacggcccacaggcaattcctgcaatagaaaaaaagaatcgccctgttgatcttgaccatcaacagggcgggtgaaacatcgaccagcttgcttatcagaaaggaggacgcttcgcctcccatcctagccgatgggcggggcgaagccatacccgaaatggcgaacgtcaccagatacaagacaaccaagggcgaaacccgataccgtgtgaggtaccgcaagccggacggcacgcagaccgacaagcgcggattccgccgcaagatagatgcggaaaactgggcggcggaacacgtcaccatcgccaaagcaaccaacagctacgtggatccggaaggcggcaaacgacgcgtcggagacctctacgagcagtggctgaaggaaaaatggccgttttggaaggagaccacgcggatcaacgccaccgacgcatggaggctccactgcgaggagcgttgggccgaccgtcggatcggcaccgtcacccgcgccgaagtccaggcatggatcagcgtcgtcatcgagaactcgggtgctccctccgtgagccgcccgtaccagaccatgctcggcatctgccgcatggccgtgcgggacaggctcatactcgacaacccctgcgaaaacgtcgaactgcccaaactgccgaggcgcaagagccgtcgcgtgtacctgaccataccccgtctgctcgcattcgccgacgaatgctccaaaggcaagcatctgggggaggagcggcgggcgctcgtgctgacattgggcttctgcggattacgctggggcgaggcggcggcgttgaaggcccgcgacctggacttcgataggggagtgctgcacgtgggcggcaatctcgtatatgtcggagcccgatgggtcgaggggtcgccgaagaacagcgaggaacgcgacgtgcccatgccgcttatcgtcatggaggcgctgaaaccgatatgcggggaacgcgggccggacgaaagggtgttccgtgatctgcggggtggcccgatcatgaagcagagcgcggcgaagacgaccggctggtggcatcacgcgctggtgcgcctgggctggccgaaggaggattggcccacgccgcatgacctgcgtcacaccgccgcctcgctggccgtgcatgcgggcgcgaacgtcaaggcgctgcagcggatgctgggccacaagaatgcctcgatgacgttggacgtgtacgcggacctgttcgacagcgaccttatggacgtggcccgtctgctcgatgccgcggtgcaggtggagacgggtgtggaaacatgtgggcaaaatgtgggcaaaaacgttttgaagcccgcctgaaaccctcagaaacgttggaatcacgccattcctgcgaatggtggttcttcaccaagttgaaggatgcactgcgctgaatttccctatcctcatgtcgtacatccgatgagaaaacgttagatcgcatatcaaatagccggttgcttcaaaaacgaagcaaccggctattttgtcaatgtttctgctgtagcaagcggattgcctcacgcctacaacagccaatcattaggcatatctacgtgtttatttgagcaatgaccggcacatagcgcgatactggttcacatagccaccgccgaagaacacgcagtggcctgcgatggggtagagctgccacaatgtggtgcgctcctgccatcctgctttcagcggatgtacggactggtatccgtcgagaatgtcccgcaagtacgacatgccgaataggtcaagcatggcgagatcctcttcacgatgcccgccgtgcgcggctgggtcgatcagcaccgcttccacggatccggaatcggccgaccacatgacattgccgctccacagatcgccgtgcactcgtgctggcttgtcattggccgccttgcccagtatttcaggcaacgcttcaatgacggcctcagtcagttccatatcgtaatcagtgagttcacggcgcttcataccaagctgtaccatcggacggagcctgccttcggccaaatatgtcgccacatcatcccattcgcctgcgtccatgggaacgggatcctgcaaggggccgaaataacaagttcccgtatatccggctggggcagatccaaagtaatcggctccggcatcatgcatacgtgcgagagcagcgccgaaatcatgcgcggcctgcaaagtcggaccacaggcgttcactcgttcaatgttgagataatccttgccccagtcgtacacgtctaccacacgtggcccgcctttggattgcgcttcgccaagccactgcaggccacggccctcgcattcgaagaaaccttcaggactgaatgccctgctcttgcgatatttgctcatgctgcccgacctttccttgcatgatccgccacatttgcgagaccttatggaatcgttagtgaagctccgatgggttttggcaccattgtgtgcatggtttgagacaactcaaggatccatagcgaaaaattagacccctctcgctagtcttggatgcggaaaagcagacgaaaccattgatacatataaaagagggttcatgaatttcttccaagcgattttccttggtctggtgcaggcattgaccgagtacctgccagtttcttccagcgcgcatattcgcattatcggcgatttgatgctgggatccgatccgggcgccgcgttcaccgcaatcatccagatcggcaccgagcttgccgtgattttgtatttccgacatgacatcatccgcattcttggagcatggttcggctccctgttcggcaaagaaggcaaggatttcaaaagccgtatgggagcgcacaatccagacacgcagatgggctggttcatcatcctcggcacgatgccgattctgattgccggcctgctgttcaagcatgcgatcgaagggtcactgcgtaatctgtggatcaccgtcaccgtacttgcattgttcggcgtgctgctgtgggtggtcgacgcccgttccaagcaggtcaagaccatgaaggaaatgacctggaaggatgcgctgatcttcggcatcggccagatgctcgcattgattcccggcgtttcccgttctgggggcaccatcacctttggacgcgccatgggatacacccgtgaggcagccgttcgagtgagcttcctcatggccattcctgccgtgttcggcgcaggcattctggaagccgtatcggccgtcaaggacgttgccgcgggggatgccggtatgttccccggctggggtcctaccatcgccgcagccatcgtggcatttgtggtcggctacgtggtgatcatcggcttcctgaagtttgtttccaccttctcgtacaaggcattcgccatctaccgcatcggcttggcgatcgtcgtggcattgctgctgattaccggcgtgctttcgccgctggaagccgcagctgcagcgtgaatctaattcgataatcgaataacaaaaaagtcgggccgatcatcctgcgatggtcggcccgacttatatattcactgcttatcgccaatcacaacttaattgccacgcaagaacgattcagcctcacgaatcagctcttcgcaagcgggcatgccattcgacgcgatacgttgcgcttgagcgttcaaatcgtagtcgcgttccagacaggcaagataatcgccggcatgcgtctgctcgacaatctcgtcggcagccttgcgccattcggcggcttttctgttcaaatcaccttcagtcagcggatgctcaagtaaaagagacaatgcgcgaaccaattccagcgtgccctgcaagcactcggtattcgcacagtaatggggtacggacacccacatggatgtggtatgaaatcctgcgtccgccgcaaatgcgtcaagaatgttggggatgcccacagggccgttatattccttgtcgggttcgctttcgcagtcatttttggaaatgtcaagcggcaaaggcctggtgtgggggcaatcgtcgaacatggatccaagcgtgacgataccgctcacatcgtagtcttctgcgatgcgcaacgtctgcctgcagtattcctcccaacgataatttggctcgggggcgatctgagcgagaaaatgcagcgagggggagactgcaatgtcatagaacgtggtctgtggccagatgattcgtttacgaccttgtaccgagcaaatcatcggacgggctacctgatagtcgtagaaaccctcattgtcgatatgatgcacctcctgtgaatcatatcgcgacacaagatgccgtatgacgttcgtcgcagcctggcaggcgtcattccacccctcaaacgcggagatcattattgtctcgcgttttttcgtctcctcacacatgctttaaatgtataacgaaatcatatttccgcaaacacgcttccgccatcggtgaatgtgacgagcagggcatcccgatctagacaacagcatctcaaaatacccgaatgtcaagaaagctcaaaacctttttcggtagataaaagccctttgaaaacagcaaaacacgaacacgacacgcggacttgcaaattttgagaatgcggatatagtagatactcgtgctcaggcagtagtactgcggaggacatgcggacatagcttagttggtaaagcgcaaccttgccaaggttgagaccgcgggttcgagtcccgttgtccgctctaaggttccgattgattatcgacctttagggtgggttagccaagcggttaggcagcggcctgcaaagccgtatagacgagttcgactctcgtacccacctcttgttgtgcttgacgtgtgcgagtgcgacgcatgacccgggcggttggcgcagaggtagcgcacttccctgacacggaaggggtcacaagttcgaatcttgtatcgcccactggaacgtgagttcctatataacccatcatcgggtgattggcgcagcggctagcgcacttccttcacacggaaggggtcataggttcgattcctatatcacccaccatcgggcggcacgtcgtgccgccttttttgttggtttcgttgggtttccgccgtttcgtgcggcatgtcggaaacgggtggcgcgtggtccatgctgtgcggcgcaaagctgaaatcaatccccgcgacgaatataacttcgaatacagttttaagtccggaatacacactatccgggctttttccgtgttctttcaaggtgtacggctacaatggcagcttgtgagtgacgaagcattgaatctcaatcagccggtcaaagacatggggccgaacgagttgaaggcttatgccaggctcggcaaacagcagcatgacgaggcgaatcgtgagctggaacgccgttggcgcagctatgatgacatgttgccaaacgaccagttcgtgtcaattatcgacaagactgagggataagacccactttacggtgtatgattcgtgaccatgccggtctcaataccggctatttgcaagggtaatgactagaatggcgactatgactgatccgattccaagcgcaggtgaaacgaccatcattggccttcctgcaataaccgtaccggtgacttccaccggagaccgtcctctgacgaaagaggaccttgaaaccatcatgcgtcttgccgatggcacggcattgctgatctcgactaggggagcggtgtcggggtcgcggtatcttcttgacgaggatgagattaccgtcggccgtgatccaagagcggacattcttttggatgattccacggtttcccgcgcccatgcggtgttccgcaggtctgacggcaggtattccgttattgatgcgggcagcttgaacggcacctatgtgaaccgccagcgtgttgatcagcaggagctcaagaatggcgatgagattattcttggcaagttccgtctggtttatttcgacaataaagccgtcattgccggttgatccacgttatgcgggatagactgtgtacaacagcttcgcgcccatgagcttcgcacgaatgctcatgggcgttattgtagatgtcgtaggagagcgtgatgaacgaagcagagccaacaacgcggttgcgtctgcatgtgtcgactgcggtgcagggggagttattccccgcgaccggcactcagccggtgacgcgcggctacaagggtacggtggcttcaaaagtagcaggcatcacttatcgtcaacttgactattgggctcgcagacaaatcgtggaaccttccatcacgccgtcgcatggatccggttcgcgcaggctgtactcgttcaaggacgtggtgatccttgctgtgtcgaaaagactgcttgacgcgggcatcaatctgcaaaatgtgacgactgccatcagttttctgacgcagcgtaccgcggaacaacttgagaatatcacgattatgtgcgacggtcagcaagtgcacgaatgtacggatagtgagcaaatggtggcgttgttgcaaagcggtcgggcggtattcggcgtatcggtgggatctttatggaagcagatcagagagactcttgcccacgaggaatacgtcgatctgaccaccatgccttccatgatgggtggaaaccgacctgttgacgatatcactgcaatgcgcatgagaaagaacttcgaggcgcaacatcagacacgcgccgccgcgtcactgtaacataccagaatgcatgccgtatggttgatgcggactaagacggatgtacgagtcgttgatatgagatagatatgtacagacagacatacaacaggggagcaatacatgtttgatattctgccggcattgctgtggattgtcgcagcggtcatatcgttgaacatttgttcgattactgcaattcgaggaaatatcttctcaaaaaccaagagtgacgtatatccggtacgctggtcaattgtcggattgcatttcacatcgctgatcatcggagctctgccgtatccgatatatacgatgttcaaacccagcttttccttgaaatttcagcatttctacgaacaggttggttggccgtcggcagcactgatggttatgctcatcgccacggaactggtgtttatgtatctgcaggcccgaaacggcatgaaaagcgaaatggaaagaaaactcagccaagccattaaggactagccaaaagacatccatcgaagcgaaaacgcagccgtgtggaaaaacgtccagcgaagcgaggacgcaccatccatcatgccggtgggttatgtcgagcaaagtcccgaaagggacgtgctggcataacccaccgatgttatgtacagaaaagagcgtcagtcgaaaactgctgtagcttttctgacataacgtacattatcggacaaaagtgggagcaggtgcagggggtatttgagatgtacgcgatctctcaaaaccccaggtatgcaaatgtcatcgctggcatgcatacccagggtttctttgtctttatgcacaagatgatccgctcgtgcatcagccgttatctatcagacgaaatagtcttcgatggtttgcgcaagctcactaaccgaatcgatcaccttatacgcgccatgttctttcagctcgccaggctcggcataaccccagccgcatcccaagcaatccagaccgcacgctttggctccgtcagcatcggtccaacggtcaccgaccatgagcgccttatcgccagcggcttcgtcaaacccaatgtggtcgaacgcccattgaataacctgatctttgtcgagacgcgaattatcttcgctggcaccgtaaatgccgttgaccatggtgtccaaatggaaatgctcgcaaatcggaatgcactgatactgcggcttgcagcttgcgatcgccaagtagtatccgtcagcacgcagtttggacaactgttctgggataccgtcataaatggtattgttcaaacggcccggaaccttttgacccggattattcggatcatcgaacaccgcttcctgcgcataatacctgcggtagatggcaatgccctcatcgagtaagtcgtccggaatattattgcgctgcaacgactcgacaattgcaggaccaatgaatcgctgcaactcctcatcatcaggcactggataccccagttcctcaaataccttcaccacacaaccaatgatgcccggatcagacttggtcaatgtgccgtcaaggtcaagcagaacgactttcttgggttgcttggtcttctcggacatgagattaatgcactccttgttaaatgctcgatgcaatgtgaactgttcagataacaattatgcccggtcttactgaccgggcatgcagttcaagtgtcgttcaactactggttactcgtagtctggaaaccagccgtcgcgatgcatctgcagacgcttttcaagcaacgtcttcagctcgtcttcagtacggcgttccaatagcatgtcccagtgtgtacgggtcggcttggaaatctcgtcggcctcacgatcctcgtcgccttcacgatgcgcggtcatgccgcaccggcactcccattcctccggaacctccgcgccttcagcgaacggcagaatcgtgcggtgtccctttgggcacacatatgcgacgtcgtttcgcgccgcgaaatccacattgtcatcagattccaacgactttgcgccgatgctcatgcctcgcaggctgcgttctgccatattgcctttgcctccttggattgtctgctctgtctaagctacagaacagttcggacgtgtcttttattccttattcgtctgcttgatgttcgattttagtcgacgccggagtatgcgacgatgccacgattgatgcgatcgtacgcctgttttgcgactggcgccaacgtttcggcacgatccgcaagatacggtccagccacggctatctgctgaagcacgtcggcaagccgtttgccgttacgcacgaaatcgccgcccgtcagatcggtgccgtacagcacctgcgacaggctttcaccttgcgcccaatcgtagacgatatcggtgatgccaaaatcgagttggcgaggctcctcaagcatgtgatcctcacataacatggcaatcgacgcatggacgcccttaagctgcgctgcgcacacggcgacgttcccttgaatgcctccagggtaacgacgcggctctcccccgcctcccctgcgggcttcgaacaccaacgatgcgacgacgctggccaattcacaggcgttcaacccgtcaaatgcgccatcgtcaatcgcctgcgccaatactagatcaagctcgctgtacaaatgccgcaacagctggccacgttccgtgagctgataatcaccatggcccgcggattcccgtaccggctgaagatagccgagattggaaagcacagcgcaaatatgatcaaactgacgtgccacggaaccggttcgcgaatcgtaacgatgctgtacccgttccaactcgcgcatctcacgagcccaacgatgtccccatttcaagtgcttctgcacatcagggcatttacggcatggatggtcgcggtcttcttctctgagtttcttgatgcgtttgtcaagatccataaacgcctggctgcgttccttctgcgtacggaacacctcatgcttgagtttgcgacgttcgttcttctccaaatcactcaaacgcatccgcaaacgcatgaattttttgaaatcgccgaattcacactggaaagcctgctcgtatccttccagagccttgcataaggtttccatctgtgcttcaagctgccatgccgactcgttggcttcccattgcgcaaaggagtggtcaagcgtaacgcgagctgtttcatagtcgctggaattcaatagattgacagccatattgaaggtcggtctgaagcttgagtgaagcggatacactcgtttgctggacaaggcggccgcagtggcgggaacaaaaccatggtggtccaccacaacggcatgtccgatggtgtcgatgccacgtcgtcccgcacgaccggtcaactgggtaaactcgccgggagtcaacccaacatgcccggtgccgtcgaatttctcaagcttttcaaccaccacacaccgtgcgggcatgttaatgcccaaagccagcgtttccgtggcgaagaccattttaaccaagccttcttcaaacaagcgttcgacaatctggcggaacaatgcgaccattcccgcatgatgcggagcgaacccttcttccagggcgaaacgaaattgcgagaaatgcagcgctttcaagtcttcttggctcaactggccttcgaccatctcatcgacgatccgtctgatttgttgcacttcgtcgctggtggtgagttccaagcctgcgttgatgcattggtcaaccgcttgatcgcaaccgtttcttgaaaaaatgaagtagattcccggcagcatgtcaagaaaattcaactcgtccacaaccgcccagcgtcgaggcgtatggcgttcgaccttatgcgggcgatcgtcccatcgtccacctttacctttggccctacgcttatcaggacgtcgctcgcccttgcgccgttccgcctgacgatcaagctgatcaagtctgtttatcagctgcgcattgagtttgaccgtctgttcgccattggcgtcacgccgatataggtcgatgagttctggttcggtatggtcatctgcctgtacgagcacatgctgctccaacggtaccggacgctgttccgacatgaccaacgtggttttgccacgaacagattcgatccattcggaaaaatcctcgacattggaaaccgtcgcggaaagacctatgatgttcacgtttttcggcaagtggataatgacttcttcccagaccggccctcggaaacggtcagcaagatagtgcacttcgtcaaggatcacataacgaagcgcttcaagcgtcacggaatgctcatacagcatattgcgcaacacttccgtggtcatgaccacaatatccgcctcagagttgatggacgtgtctccggtcagcaatccgaccttatccgttccatactggtcgaccagatcatggtatttctggttgctcagcgctttgatcggcgtggtataaaaggctttgacattccgcgtctgcgccagatagatggcgaaatcggctacgacagtcttgcctgctcccgtaggagctgccacgagcacattatcgccagcctccaacgcatcgttggcttgcatctggaattcgtcaagctcgaatggcatggatcttgcgaattcggccgcaaccgtgcgctgcttggcctgcgtttgtttgaatgcggcataccgttgcgcgggagacaactccacggtctcattgattttcgacgggtcagtaccgttattacggcgacgatgatgggtcatgattccttaatatggttgggtcaatcgttacaatgacgccattgtgcccactgttgagcatgacggcttcgcttcgcttcatgcctctcaatgactccggcatgggcatccgcataacgatctgcagcatcctttaaaggtctggtaaagaaaggcgcttcattctcgttgttttggggcaatggtttgcccatcgcctcgattcgttttgccgtccgttcacccagcttcgccacgtccttgaatgctcgatagccgtgtaaacatgcgtagacgactccggaaacaaccattgcaagcatgaacagagcgagcaacagccaaatccaccaaggcatagtctctcccccgtcagccttcattctcacgatcgccaatgctcagctcatgctgggcacgggcgacaatcatggtacgcaacgtttcgggagctacggcagtgatatgccgtgcgtgggaaatacagaatgcgacataccaggaatcggacgagacgatcagatgcaccttctcgccctctccgcacttttcgactgttgctcccgacagcccgtcaataaatgacagatcatcctgattggtgacgaacacagctggagttccattatcgaagctccatttgcgcaattcggatgcgggaacgtcgggaatgtcgattttcgcggtaggttcaaccagttcggccttttcaatgcgggaaatgcgaagcacctgccagatgcgaggctttcctgtggccttgttgatcgtggtgtctttcttcacgtacttagctttgtcagccggtgcagcggcagcgacgtcagtccatacggcaacgtagaagactccctcatcgacgaagatcttatctggcgcgacaagcttacgctgggtccttccggcgccatccgtatattccatgtcaagcagcaagctcttggagatcgcgctcttcacaatggagaaattacgcggttccatctcataaccggtcagactcagccaaggcatgtcccccggctcaacatgttgacgaagacggctgtacaacgattcagcctgttcacgcaacttgtccggcagcaacgacgaatgcgcaagatagctcaccgatgcggtaagcatgctcaaatactgctgggagatacctgccaagcgttccagcccaagcgaattcgtggcggaaacaatgccttcagcgtcaagcaacgaccagtcgatgtcaaagaactggcttcctgccatctcaccatcgtcggaaaccgtagtcagcgtgttgatgtctttatgaatgacattgacgaacttcttcagctcgtcatcggacttcggtttgccaatgaaacgttccgcaagttcctcaagcgaatattcttcgccgaggtgcgccgaaaggaacagcatcaggcgcagacgacggtcgacttcactacccgtctggaatgcggaattcttcttcggacgccccttgccctcctctgcatcgtcgtcagcgctgttgcggttgatttccatggctgtgacagtggagctatcgcctcctgtggattcgtcggcaggcacgaactgcgtggcggcattcaaacggcggttgaacgcgtcgacagcctcctgaggactgacgatggaagcacccggatgagaaagcacgaacatggccagatcatcggaatcggtgtaggcgacgttcaaatgctcgccgtcaacatctacagtcgccgcgaaacgacgctggtcaacgaccttgaccaattcgtcgggaatggattgcgttcccagacccggagcgatggaatcaagaccaagccctggagtcggagtctgagggacgcgaggcgcggtacgggacgtatgctgcgtctcatgtgcgggagctgaggaaatcgacatggaacgggccagatagttggccgcggcaagaatcggcaaatcctcgtcgccgaacagcagacgaacgcgaggctcatctccaagctgcagacgataggatgcgaaatcctggccttccgacttagatgaatactcaggctgcctcgattcgatggcgatgcccatggccgcaagcttggcacggtcacgctggaattgcttggcaaaagccgccttcgccgcctgatcagccagctccccataggaatcggcatacgccttcacacgctgggcaatctgacgggaagtgagccattgcgggaaagctgaggaaagcacagccaatacatcaagttcgtgcttgccccatttgtcggagaaacgacgccttccgttactgccctctgccattagtcctcacgtctcgttaacgtttcatcttaagtgcctagccggttcaggctctgcacacacctctctatgatagagggttttcgttcagattgtgtctattttacgaaaaaatacagtttttcgtgttgaggctacccctcgaatcagacccaatcatcaggctcaacaccttgcgggccaacgtattcgccattcggaacataactcggctcacttgtgtcggtcagccgcgcgtcaccgaacagtatcacgtccctgccgaaggtccagtcaccatcgatgtcgacggaattggccgcggcaagcgacggaacgccataagggaatctcgtatcgaaatcatggatgttcttgtaataccgcgcatccaagtgaacatccgggaagacgtaattgccatcttccatctcgtactggtccgtcagatggaatcgatcggatcgcatgataaacaaatcgtcggtggttttcaccggcaggaaacgcatacggtcaacgcatacgcaggtagccccgtcgaacaacgtcaccgccgctcccatggctgtttccagctggatgaccggctcgctcgtcggatcggtcggatcgacggtcttgttattgcgaatcaccggaagaggaagcacgccatcatatgcggacagcttggccttcagagcgtcgatacgcacccagatgctgttcgtgttaaaatacggatgcttttcgatgttctgcgcatcatccttatcgtccggatgcacctggctcatctcacgcaacatcaagcggccggtcgccttgtcccgcacgatatgcccgcccttgcgatcagctggagtacgttttgcgacctcgatcatgaatggcgcaccggtattttcgaagtgctgcgccagcgtgcgcgaaggacgtgcgccgagattgtcggaattcgagatgaacaggtatttgaagcccttctcctcgaggacgtccaataggccggattcccaaatggtggagaacaggtcgccatggcctggcgggcaccattcaagttccggatttgccgggaagctgacaggaagaccggtttccgcaccgattttcggttcctgatgctgcacgatttccagaggaatgtcctcttgatggaactttttgttggcacgcagcaccttcatggtgtcattcgacgtgcggaaggagttcatcaacgtcaatggcagttccacacccagacgagtgcgtgcagtcagcacctgaccgatgatgatgtcgatgaagcgcatctgacgtgccttatggcgacgcactggcagcaaggacttggcgcaatccaagcccatggacgtgccgaggccaccattaagtttgaggaacgcggttttggcaaaagcatcgacggctttgtcatggttgatggtctcgtagacatcatggaagctaggcactcccaccagaggctcaacatcatcctcacggatccatgtgcttgcttcctcactgcgccaaacctcgtacagtcgtttgaattgcgcaatggccatatcggtcatcccgttgtcccgcatctttgcggcggaatgttcaaatgcgtcctcagtcaatgtctttccctttcgtgcgggcgtcctgttctcatcgtacctaggcaatactacgacaaaattcccatgacgggggcttttggtggcaaaaagggaaaattcttgacaaaaatgacatcccaagaactcttttatcatgtttcgcgaatcgtgcgacacgatgaatttgaaaaatagagcaggttgtgctatgtttcatgttcggtgctttttgcatcgttcggaccatagcgcagtttggtagcgcacttgactgggggtcaaggggtcgcgggttcaaatcccgctggtccgaccagaaaaacccgaattcatgcgatttcgggttttcttttttaggatgtcagtcttacgcatgcaggtaaggggtgattgtcttgaagtcgatggacgcccagccacagtttgacgacgttgacggctttgcccacgtgtttgactcatccgagcttgaggatgagtggaagatacgtctgtcccgggaacttggcgtagcggccagggagcgggcgaagcatgatggcatcacccttaccgaactgacgcgcaaggcgcttgaatgcgacgatctgaatgagaccacggacaccgtccgccctggacgaagaccgaagaacaccgacggtcgagaacagctcggagacgaatggaaaatcaaactcccctatgccatcggcaagatggcacgggagcgcgcgtccgaggaaggcatatccttgagttcgctcgcgcggcgtgcgatcagcggatatctacgtcaacgggatactgaggaacagccgctgttttaagcatgtgacaatgagttacgcatgattggcgtgcactgatctagcaaatatggatggtggccgcacacccaaggaatggtgtgcggccaccatccatagaaacttacttgcgtttcttcttctctcgaatattcaccgaaatctgaatcggggaaccttcaaaaccgaattcctcgcgcaggcaacgttcgatgtatcggcggtaaccatgctcaaggaagccggtagcgaaaatcacgaaacgcggtggacgcgtcgaagcctgcgtcgcgaacaagatacgcggctgcttgcctccacgcagtggatgcggatgggcggcttggattttacccaagaacgcattgagcttaccggtcggaatacgcttgtcccatgattccagcgctccacgcatggctctggccagacggttcgtatgccatccggttttagccgacagattcacgcgctgagcccacgttacacggtcgaattctgtcttccacaagcgttccattcgctgacggtcgaaatcatccatcaaatcccacttgttgaacaccaaaacgatgcatcgaccggcgtccactgcttggctcatcaccttcaaatcctgatcggaaatcggttgggaagcatcaaacagcaccagcgcaagttccgaacgctcaatcgcggcctgagtacgcaaggatgagaaatattcggcaccagacagcttatgcaggcgacgcttgatgcctgcagtgtcgatgaacagccaatcctccccatcaaccgtcaccacttcatcgactggatcgcgagtggtacctgccaaatcattgaccacagtacgttcctcgtgagccagctgattcagcaaagacgacttgccgacgttcggtcgaccgaccaacgccacacggcgcaaatgggacggagtaaggaaaccggatgttttctcagccttcttcaacgaatccaaggcagcgtcaagcagttcgccaataccgcgaccgtgcatggcggaaatgccatacggctcccccaagcccatcttccagaattcagcggtcaaatattcgctctcacgatcatcaaccttgttcaccgccagcgtgaccggcttgccggaggcgcgcagcatcttgacaatgcgctcgtcggtgttggtaagaccaacctggccatccaccacaagcaccacagcgtctgcaagctgaacggcgatctgcgcctgggatgcgatggcggattcgataccttcgacgtcggcttcccagccaccggtatcaaccagcttgaaatcggtgccggcccattcggcatcgtagctcacacggtctcgagtcacgccgggagtgtcttccaccacagcagcgcggcggccgagaatacggttcaccagcgtggacttgccgacattagggcgcccaacgacggcaagcacgccaaccggcttcgggccggaccggcgttcgccgccaacgaacgacgatccatcgatcagtccttcatcgccctcatccaactcataatcgtcaagattggaagcgtactggcgatactgctgctcttcgatggcatcgtcgacaatgcgcacaagcacatcaagcgtttcgccgaaattcaaatcggaattatcgacggtcagcacgccttccgcggcagatgtgaaattcgtgaccttggaatcagctgcatctcgcgccgcaacattttctgatccgacaccatcagttgactgaccggaacgacgagcctgtcgcacctcttcacgggcggtgagcaacacacgcacttcagcatccggcgcaacaaccgtagtgatgtcacggccttcggcgaccactccggcaccctcagaaaaagagtcagacgcagcttcgcgtgcgatgtacgcgcgttgagcggcaatcagcacgtgacggacgggaatgatgttcgacaccttggacacatgggatgacacttcggaggaacgaataacgtcgctgatgtcttcgccgtcggcatataccttcgaatcgtctggatcgacgctgatgtcgaaatgaccttcggtaaagaactctcccacggtttcggtgaccagttgttcatcgatcgtctccgcgtcaaggtcaatgcccttgttcatgcaccaccatgcgcaggcacgatacatggcaccggtatcgaggtaagcgaaaccgtaatatttggccaacgccttggatgtggaagacttgccgacacccgcaggtccatcaatcgctacgcgaatcacaggcccaccgccttggacagggaacgcacctcggtctgcgaaagcacacggtacgatccggatttcagatcgccaagcttaatcgggccgatctgggtgcgtaccagacgcttgaccgggaatccgatcgaaccgaaaatgcgacggacgatacggttcttgccggaatgcagcacaaccttgaccagcgtgctgtcgcggctggcatcaagaatcgcgcaacggtcgagcttgatccaaccatcgtcgagctgcacgcctgtagtgaccagtcggcggcacacctgaccgctgatgcgaccttccaacgtggcgatgtaggtcttctcaacctcgtacttggggtgcatgacgtgctggctgagctcgccatcgttcgtcatgagaatcaggccttcggaatcataatccagacggcccatgtggaaaatacggtcatacttgtcgccgacgatatcgctcagggtgtagcgtcccttcggatcctccatggcgctcagcacacgcttcggcttgttcaaagcgagcgtgacatgattgggattcacgcgaacacgggagccgtccacacggacttcctgatgtttcggatcgacgcgagtgcccaattcggtaacaagctcgccgtcgatttcgacacgtccttcagtaatgatctcttcacatttgcgacgggatccgaatcctgcctgagcaagaagcttctgcagacggataccttcattatcgtgtgtgtgcgccttcgcggcgcgggaatatgcgtttggcatcgttctcccaacgtggccggataatacttatagggactgctggtactatggcagtcgtttggcgatttcccaaaatcgcaacttgtccactatatgacagaggaaagactatgactgctgttgaagcaacgcccataaccaaggaagaacaaagcaagccgttgacacttcgtgtcggagcggaacttgtgggaagcttcatcatttgcttcgcgatttatgcgatctgctcgcttggttccgcggtgtatggcattaacatggcgttcatcgccctgttgacgggcatcgtatacgccgccgtcaccgtaatcttcggttccatttccggagcacagttcaatccggccgtatccgtcgccgccatgctcactggcaaaacccacgtgcttgatggcattctgtacatcattgcccaagtgctcggcggtatcggcgcgggtgccgctatccggttccttctgccgacttccgagcaggtgacattcaagatctggatgacaccaacggtcaacggtttcgataagaattccgtctcctactccaccctcggcaattatggagtgaccctcggcatcactctggccatcgccgttgaagtcgtcgcaggtatcattatcgttgcctccgcactgcgcaccacggacggacacggcgagtccaaaacaaaccacgccgttgccatgggccttgcctacggcatcggcaccgctatcacctatccggtgaccggagccgcactgaatccggcacgtgccacgggcattgccattttcgcacagaatcaaggactgaatgaagagccgctgcaacagctgtgggtcttctggatttgccctgttcttgccgctgcagttgttgctctcgtcgtcatcgtcgccggcatgattggtacgaagaagaacgtgccggatactgtcgagacaatcgataaggtcgaaggcaataccgttcttggcgaagcgtcagttgccgacgggaacgatggtgagcaggatgaacagtcctacgcccaagccaatgccgatgaaagcgtcgaaagcaactgaccgaaccttccatggactgcgctcacgcaatgccagtctgaccagtccagtcgctatggccgtcaccgcaatcgcagcggtggcggcttttgtatatcctgcgaccgcaagcaccgtcgcaacaatcactaccgcggcgacgatccattcgaaccacggtttgccctcatgatcttcggaaacgtaaggatggctcattccggggcctttcatcttgcttgctgtacaacaaccgtaatcataataaaacgtggcgtccgaaaccaatacggaatcggacgccacgttgaccaatacccctcacatgagaggcggcgtatcagtggaagaagtgacgggtgccggtcacatacatggtgacgccggccttacgagccgcttcgaacacttcctcgtcgcgaatggaaccgcccggctgaacgatagccttaacgcctgcattgatgagaatttccgcaccatccgcgaatgggaagaacgcgtcggatgcagcgacagcgcccttggtgcggtttgcgccatcagccagcgtgttggcgcgttcgacggacaggttcgcggaatcgacacgattcacctgacccatgccaatgccaacagtggcctgatcgtgggcgatcaggatagcgttcgacttgacacagcggatggcccgccaagcgaaaaccagatccttgacggtctgctcatcagcaggctcgccggaaaccagtttccaagcgttcggatcgtcgcccggagcatcgataagatccgtggactgcaccaacagaccgccgtcgatctgacggaactgcgtcttggacttcggcggctcggaaaccttcagaatgcgtaggttctttttcttggtctgcagcagttcgagagcgtcggcatcatagtcgggagcaacaatcacctcggtgaaaatcgggcggacgctttccgccatttccatggtgaccttgctgttcgcggcgatcacaccgccataggcgctcatcggatcacaggcatgtgccttcttgtgcgcttccgcaacagtggcgccaacggcgaggccgcacggattgttgtgcttgaccacggcgacggcaatctggggagcaaaatcccatacggcacgccaagcagcatcagcatcaacatagttgttgtagctcatcggcttgccaccgagctgttcggcatgcgcgaaaccatcctggttcagcggatccagatacagcgcggcctgctggtggggattctcaccgtaacgcagcacgtgggcacggtcccaagtacgagtgaatgcggccgggaacttggtctcattcacttccggctcgtcttcggcggttggctgctcaacggtcaaaggcttcggccagtgctttgcagtccactcgttaatggtggcatcgtaggcggcagtatgggcgaacgccttgccggccagccaacgacgttcttcgagagagaagccctctccgttttcgatgcgcgcagctaccagtgcgtaatcgttcggatcggtgatgatggccacagtggcgctgttcttggccgcaccgcgaaccatggacggaccaccgatgtcgatcttctcgatggtggcagcctcatccgcgccagaacgaaccgtatcggcgaatggatacaggttgacgaccaccagatcgaacggcttgatgccgaacttttccagctgtgccgcgtggtcctcattggtcatgtcagcgagaatgcccgcgtggatatgcgggtcgagggttttgacgcgaccgtcaaggcactccggaaagccggttacttccgagacttccgtcaccttgacgccaagttccgcaagacgcttcgcagtggaaccagtggaaaccacttcagtgccggccttgatgaacgcttcggcaagaacctcgatgccttccttatggaagaccgataccagagctcgccgtatcggtcgattcgttgttgtcaccctgatcctccttgttattgatggttgaggtcactgtgcgggccgcattggcgacctcacgattatctgattcaagagccgcagtggacgcaccactcctgctctcgcggacacgctttactatccagcgtattccaaaaaacatggatacggccaccaaagtcagcagccatgacgaaaacagtcccacggcagtaggctgtccaatcttacgggtcgatgaaatcacgtcgacgccgatgtgcgcaagatgttttgagcccaacgctccactggagatggcaaaaagcagactcgaacataccgatacaacggtgcaggaaatgcagaacgctcccgctggataggcaaagccaagcactaccctcttgacatcaatctgctgatcggagttgcctactctgatatgaaagcccttgttgaacagcatgaccaccatgcccgcggcacaagctaaagccaaaggaacgcacatcaacgcgatccgaatccaattcgtttcaatcgcttgaggaagcaaaccgaatatcggcagagacggcaatgccgacccctgaccgctccacatggtgaattccgctagatcgccaatcgaaaaaccggccccgaatacccaggaaatagcccaaatcgcgatatttggaatccaagcgatcatggcgatcgtggtgaggatgcgagaaccgttctgcattcccgatagctcatacaacttcaccatggccgactggttgctgaatgcccagtacaagaccacaatcagtccaatgaccagatagaccgtgatcaacagcacacccaaggcaacaccaatggtgacggttttacggaccggagacgaaacatgctcgctgatccaatccaaatctcgtttggtcagtggtgattcgggaatcgcggcaatggcatagccaagtacaaagacgatcgctgttttcacagcaaccacgcccgtcgtatcaacgagtttgatgtcaaggctattggcgaagaacacattgatcaacacccagcctatggttcctgccacgcatccggacagactcgttccgacgcgtttggcgagcgatgcgataagagcgatcagcaaaaccgtaagcagcaacggcataatcgtcaaagtgatggatccggttttgaaaccgttcccttggctgagaagcacaaccgcctcggtcaaggaaacagagaaggcggagagattgtcgccgccttcttccatggaaataaccagaagcatcagcgcaatgtagcagcctagggcaccggcatagacgaccatggacaatgccgccacggcaagccccttcaaccaatacttcaggttcgccatcatatcgacttggaagcgagcacctcgcgcatgatttcagcggtctgccccggagtgcgtccgacacgaatacccacggcttcgagcgcttccttcttatcttgcgcagttcccttgcctccggaaacgatggcaccagcgtggcccatctgcttgccttccggcgcggtgaagcctgcaatataggcaacaaccggcttggtcatatgctcggatgcccacttggccgcatcctgttcggcactaccgccgatttcaccgatcatcacgacagccttggtggcatcatcgttttcgaacgcctcaagcgcctcctgcaacgtagtgccgacgatagggtctccgccagcacccaaacatgcggtaaaaccaatgtcagacaactctcccatcagttgataggtgagcgtaccggacttagacaccaaacccaaaggtccacgggagacgatgccgtccggaataatgccaagattgcaaccattcacaccttccgtagaaggcagggtaagcagaccagggcagttcggaccgacaatacgcacatccttgcgcaatgcgagttcaacaaagtacgcgctatcggcaacaggaatgccttcggtgatgacaacaatcagcttgatgccggcttcaatggcttcgaccacggcatccttggcgaaacgcggcggcacgaacacgacgctcgcttgggcgccggtgacttccacggcttcggcgcaattgccgaacacacgcaacgtaacatcctcgccgtctttggccgctgagaaattgacttcctggccggccttgcgggcgttgacgccgccgacgatattggtgccggccttcagcatgcgggcggtatgggtcatgccctgatgtccggtcataccctgcacgatgacaggtgcgccatcctcaatgaaaagcgtcatttcagcgaacctccttgccattggccgcaagacgcgcggcctgctgtgcggcttcttccatggtctgtgcaacatgcagattgacacgatcggcctgagccagaatatgtagaccttctgccgccgcgttgccgtcgaaacggactaccagaggcttggaactgccaagcttgtcaagggcttccagaatgcccttggcaacttgctcgcaggatgtgatgccaccgtacacgttgatcaacaccgattcgacttgcgggtcggacagcacgatctccaaactgccgcacatcacttcggcggacgcaccaccaccgatatcaaggaagtttgccggtttgacattggtgccctgatcttctccagctccggaaaccgcgtcaagtgagctcatcaccaaaccagcaccgttgccaatgacaccgacggaaccctgaaggtgcacatagtgcagaccatgctctcgcgccttctgctcaaacggatccacatgcactgggtcagcgaagcgcttccagccatcatgacggaacgcagcattgtcatctaaagaaatcttggcgtccagggcgcacaatgtcttggaagactcgtcatccggatcgccgatcttggcaagcggattgatttccacaagcgtggcgtcgttctctttgaagcactgccacatcttcagcagaatctgtgctgcctggttgacgtcggcatgatagaagccaatgctttccgccatcttggtcgcagcctcgatatcgaaatcctccagagcgtcgatatgcagacgcttcacagattccgggtgttccttggcgatctcctcgacctcggttccaccattcgcagtagcgagcacgtcaaaatcgcgagacgaacgatccacggaaatagagacataatactcgtgaagaatgttctttgcctcggccaccaacacgccgctgaccttgtgcttgtgaatggtcatcggcaggatgtcttcggatgcaagaatggcctcatcacgattcttcgccagcttgacgccaccagcctgaccgcggtggccaatcttcacctgagccttaatcacgttggggtagccaatctgctcggcagcctcagccacttcgtgagagttctgcgcgaacactgccttaggcgttggaataccctgctcttcaagcagttccctagcctggtactcatagagatccatggattcttttcccttgatgctattggttatttacgaagaatgtacttaactcacgcaggcatggtgatcagtgaacttgtcgggcagtctcccagcgatgccatgccaccaatgccgacaagctccatgacgaagctgaaacctgccaccgtgccgccacacttttcgatcaacgaagcagccgcacgcgctgttcctccagtggcaatcagatcatcaacgacaagcacacgagatccctcatgcacgatattcgtctcgatttcgacggtggcctgcccatattcaaggtcatagctttcgctaacggtttccggaggaagcttgccagccttgcgcactgcgatgaagcccttgcccaggcgcgctgccaacgcaggaccaaaaaggaatccgcgggcttccaaacctgcgatgatatcgaattcatcggcagcgaccggcaacgcggcttcgagtgcgtcaagtagcaatccgaaggcacgcgcatctgccagaacaggcatgaaatcacgaaaaagaataccttccttggggaatcccggaatggtgcgaatctttgaaacaaggtactcggcgttttcgtttccaatcttgctaagaccggaaacggtaatatccgacgatgccatgactgtattgtccttcttttgtagtgctacggcactttgcattataggtttccgtcaggaataaaatcggcgaaaacctcaaaaatgagattttcgccgatgccttaatgagcttgtcagctgttcttctgctcggtctcagtctgcgccgcttcgatttcgccttcaatcggctcctgagcagcctgatcttcgtctgtggaatcggtgagaggattaccgttttcatcgacctcatcgtcgtgtacgtacgcaggacgcacgtattcgcggctgatggcgttgaaaccgaaacgaatctgagagccttcggaatcgatgacgatctcctcgtattcggtatcgacggaaacaaccttgccgatcacaccaccaatggtgatgacctcagtgcccggctgcaggttggcacggaaatcctgacgctcggcctgctgctgcttagccttcttggactgccagaacatcatgccaaacatgacgacaatgatgacgataagaaacacgtaatccaaagcacaactccttgggatggacgctcgaacaggactctatgtccagaacactgagtctaagctagcttgctgacatcaacctgagattcgtcagaagtcaagccgagatgatcccatgccttgcgcgtcgccacacgccctttcggggtgcgcacaaggaatccttctcggaccagatacggctcgcacaccgtttccacggtctccgattcctcaccgaccatggccgacaggttgttcagaccgaccggaccgccgttgaaattggtgacaatggctttcaataccgcaatatccaaacgatccaagccctcggtatcaatctggtacagtgccaacgcctccttgacatcgtccggatgcacagtttctaaatcgtgcacaatggcccaatcccttacgcggcgaagcaatcggttggcgatacgcggcgtgccccttgaacgcatggcaagctgatgggccgctccctcttcgagactgatgcccagcaccgaagaggatcgttcgatgagcttttcaagctcctcatgcggataaaagtcaagatgcgcggtaaaaccaaaacgagccctcaacggtgatggcagcatgccttcgcgagtggtggcgccaatcaccgtgaatctcggcaaagtaaggggaatggaggaagcacccggccctttgcccaccatcacatcaacacggaaatcctccatggcgatatacagcagctcctcggccgctcgtggaaggcggtggatctcgtcgatgaacagcacctcccctgcgtcaagggagcttagaatcgaggccaaatcaccagcatgctggatagcaggtccggaagtgactcgaatcggcactccaagctcgttggctacaatcatggccaacgtggtttttcccaagcccggaggccccgccagcaggatgtggtcagggggaacgtcacgtttacgggcagcatccaaaaacagctgcaattgcgccttgagtcttggctgtccaataaaaccatcgaggacgtgaggacgcagttcctcatcgcttaccggctcgttgccgacaggcgacgcggaaaccatgcgaagcgattcctcattggcaccggtattcgactgttcgaatgcgacgtcgttcgtcatgatgatgcgtttcacctacctcggtcaagagaagccaatgcaagtttgagcacgcggggcacatcatcgtccctcaatggaacattgatatgattgctctcgcagactgtctgcacggcatgcaaggcatcctgctgacgccaccctagtgacatcagaccttccacgacctgttccgaaccggcatcttccgcagaacgaacctctttggaagccccctcgatctgactgagatcgatggaccccttgagttcgagaataatcttctgcgcacccttcttgcctagaccaggcgccttcgccagcgcggtggcatccccgtccgccacagctttcgccaaacgttccggaggcaacgtcgaaagcaaggaaagcgcgactttcggaccaattccgctgaccttctgtaattgcaaaaacatgcgtttcgaagcaagcgaggaaaacccatacaatgtaatcgcatcctgcgaaacattcaatgacgtgtataccttcaccgtctgcccggcgtgcatggacgccaaatccgccgaaggcatacgggtctcatatcccactcccccgacctcaataatcgccgaagcggcgtcaatgaaatcgatctggccatgcaacatgcctatcatgccgtcacctcccgcatacaactgtagaacatctgttcgatagtctacattcccctacggacgccgcgttgtcgcgccgccttctgtgaggccagagcccattgacgctgtgcatcggtcaagtgttgttcacgctctcccccctgtaacgcgcctgcggggcgaagcgcatgacaaatcgctatagccaacgcatcggcggcatcggcgggcttaggcaaggtattgagccccagaatacgggcgaccatgcgttccatctgaatcttttcggccttgccgttgccggtaatcgccatttttgattcagtgggcgtatgcaaggcgacgggaatgcccctctgggccgcagccagcatggccagtccggcggcctgtgcagtccccagtacggtgttgcgattctcctgtgcaaacacacgctcgatggacaccgtatccggtgcgaaccgttcgatcttttccaccaaaccgttatagatggctaacagacgtaagtcctgcgacattttcggatcggaacgtaccacgtccacatgaataaaagaaagccggcggtatgcgccggcttcgatcacgccgaccccgcagcgagtcagcccggggtcgacgccaagaataatcacgcttgattactcctcgtcaagctgagccatgacctcgtcagaggcggtccagttggagtagatgttctgcacgtcgtccagatcatcgaggttgtcgatcagcttggacaccttctgggcatcttcgagagtcaattcgacctcgttcttcggcatcatgaccagatcagcggaatcataatcgaatccagcgtcctgaagggccttacgaacgtcgatcatctcggacggaccggtgacgacagtgaacacgtcgccgtcgtccgtaacatcttcagcgccagcttctgcggccttctcaaacagatcatcaaaatcgacgccctcggccggaacgatgatctggcccttgcgctcgaagttgaagctcacggaaccggaggtagccaaagagccattgcccttggtcagggtggaacgcacttcggcggccgcacggttacggttatcggtaaggcattcaatgatcagaccgacgcctgcgggagcgtaaccctcatagacgatatcttcatagttggcaccgccggcttcttcaccagagccacgcttaactgcgcgcttgatgttatcggcaggcatggaagccttcttggccttgtagatggcgtcgtacagggacgggttgccgtcaggatcgccaccacccatacgtgctgcgatctcgatgttcttgatcagcttggcgaacagcttgccacgctttgcgtcgatggcggccttcttgtgcttggtggtcgcccacttggaatgacctgacataatgctcctaggcaggttgcggatgtttcaaacgaaacgattctaaagcggttctaagacaaagcgcccgacatacgtatgtcaggcgcgtcaacggccgtttcatgcagccggttcacaactgatacgtcttatgaccgacggccatctggcaacgagcctcaagaatgcgttggaatacggtaatgagtcccaaaaccgcaagcaataccatggcgatggccagccataacccttggtgcgtgagcccggtaatcgccatgcccaccagaatgatgaccaatctgtcggcacgcgttgcaatgccgtttttcacttcgaaaccgacggattcggcacgggcgcgcgcatacgacgtcacgaacgacgtcatcatcgacaccatggctgcggcgataccaatccaactaatgcaatccgggcttgaccggttgatgtcataccaccaatcggcatgcaggatgaagaagatgaccactccggcaagcaatgcccaatcagcgatacgatccaatgtggaatccaaaaaagcaccgaattgggtgcctcccgtggtcagtgccgcaattgagccatccagggaatcggcgagcaccagcaacgtcagcaccaccgctccggcgaacaaccatcccgtaatgccagtggcgaaagccaccacaatggttccaatagcgccaataaccgtcaccgcattcgctgtcaggccaagggataccagtgccttggcgaatggctcgataagtcttttgaatggtgcacggagatgttctaacatgcgaattcctgttcttcggaaagcaaaagggcgtgcaagcgtcagtatgtgatgcttgcacgccccccataattcataaccgtatgcgaccgaacgtgaacgaatcagatcagtctgcgatggcggccttgaaatcgtcgacgttgttgacctgaacgcgcttcttcagcacggtcatgatctgcgccttggcctcatcgaccggcacaccgttgagctggctgccgtcacggaagcggaagctcaccgcgttgttgttcatgtcttcctcgccgacgatgaggatgaacggcaccttcgacttggaagcgttacggatcttcttgccgaaacgatcatcggacatgtcgatttcgcaacgaaccgtctcctcttccaagctggcaatgaactgctgcaggtgtggggcgaattcgtcggcaacgggcacgccaagcacctggacaggagcgagccacgccgggaaagcaccggcataatgctccagcaacacggcgaagaaacgctcaatggagccgaacagtgcacggtgaatcatcaccggacgctggtgggtgccatcggcagcgatgtactccaagccgaaacgttccggaaggttgaagtcaagctggatggtggacacctgccacgtacggccgatggcatcgcgagcctgcacggagatcttcggaccatagaaggctgcgccgcatggatcgtcaaccagttcaagtccggattccttggcgacttcagccaacgtattggtggcctcttcccagatttcgtcggagccgacgtacttgtgcggatccttggtggacagctccagatagaagtcgtccaaaccaaagtccttcaacagaccaagcacgaaggtcagcaggttcttcagctcgtccttcatctgctcgcgggtgcagtagatgtgggaatcgtcttgagtcaagccgcgcacacgggtcagaccatgcacttcgccggacttttcgtagcggtacaccgtgccgaattcaaacagacgcaacggcaactcacggtaggaacgctgacgggatttgaagatcagattgtgcatcgggcagttcatcggcttcaggtagtagtcgaagccctgcttgacgacgttgccgttctcatccttttcctcgtccaaacgcattgccggatacatgccatccttgtaccaatgcaggtggccggaagtctcatacagaccgcccttggtgatgtgcggagtctgcacgaagctgtagtggtgcttgcgatgcatttcgcgggagtaatcctccatcgcgttgatcacagcggcgcccttcggatggaacacagccaagcccggaccgatctcgtccgggaaggagaacagatccatttccgcgccgagcttacggtggtcacgcttggcggcctcctcaaggcgggtttgatatgccttgaggtcctccttagtggcgaaagccgcgccatagatgcgctgcagcatcggattggcttcgcttccgcgccagtatgcggctgcagaacgctcgatcttgaacgccttgatatagcgagtgttcggcaggtgcggtccgcggcacagatccttccacaccacattgccgtcacggtcgacgttgtcgtagaagctcagttccttgccgctgatttcggtggcggcttctggatcgaggtgggcttccttgtctttgatgagttcaatcttgtacggctgatcggactcttctgccagagcctcctcttcggtcaccacgcggcggcggaaggactgggaggacttgataatgcgctgcatgcgcttttcgatctctttaagatcgtcaggagtgaacggagtctcgacatcgaaatcgtaatagaaaccgtctttgatgaccgggccgacgccgagcttggcatcaggacggatctcctgcacggcctgtgccataacgtgggttgcggagtgacgcatgatggccaggccatcttcgctgtccaatgcaatcggttccacgacgtcgccgtcgtgcagttcggtatacaggtcgcggggttcgccgttaagacgcactgcgatgatattcttgtcttccgcgaagagctggacgccagtctgatctgctgccacctccttcgcttcgccgttgagtgtaatggagatggtctgttcagccatgagttgtcctttgctatcggggtccgcggtactaatgtgcaggcctggactgtatgtcaacgatgaacaagatagggttgagtgcagacatcggcacgctgaaagagtgaacagcatgctacagcgcgattatattttaacggatcgtatttgatgctattcgacgacatgcgcgtacgtgtattgtggcgcgcttcgtgtcgacgtgatctccaccttatcggatggcacgatcgacacggtggctccgtatttcactttcaaacgtgaaccgacgcctccagcgagattgaccgcgttctgcagattgtcgctgtctccaatcgccctgatgatgaacggcgccttgatattcgtaccgtcgcaatcgagaccgtccgccgtatcgctgatgtatgtactggtaatcacgcgaatatcgttgatttcaatgacttccgcgccgctattgcgtagttcctcaagtagggtgaataaaatcgacgcgtcaatatctcgctttgatcctttagaaatacggatgaccacgccttcgccggatactggtaaacgcccggaaagaatgccattcgattcagcgttctgcctggcgatttccgctgccttctcgttcttgtcggcggtatccttcagagagtcaagctgattggatagttcgcttttacgctgttcgagcttttgcacctgcgtactcgtttcgctaataagcttggtcagctcgtcctcgctcatcgtctcatatgtggaggtcgtgttgttcagctggatagcgtagctgaagcccagcaacgcgcaaagcacggttacgagcacgcttgaatacaggcgcgcgcgagtggccttcgcattcagcgaaaccctcttcggtttgcgcctgaccacaggaaacgatccggtttgggtgctgtcgttgttttggtctttgacgatctgctcgtggatcttggagagtacatccttgttggcatcgttgcgtctgctcatacgccgtcatcccttgaagatgaaacgtcggatggatgacacattggtgaagattcgaatgccgagcacgacgatgaccgcagtctgcagctgggaaccgacgccaagctggttgcctaggaaaaccaacaatgttgccgtaataacattcgagaagaaggaaatcacgaagaccttatcggaaaagctacgctgaaaataggctcgggcggcaccgagcagcgcatcgagcgccgccagcaccataatcggcagatacggctgaagcgcaatgggaatgtccggccggacgaacacgccaatgaccacgcctatgataagtcccaagaccgctgccattacttgaccttccttgcatatgtcacttcgccggtcaccgccgcttccagcgtaatcgatttgcttctgctcacctgaggatagataccggcttctttgaaatcatcgtacaaacgtttttgcgttttcttgctcaccgcattggcaagcgcactggaattgccgatcgcctcgatgcgataggggctttgcacggaattgacgccgataaggatcgtcgtccctgccgttcgtatggaagtctgcacaccgagacgatacccgttaatggcgatcgcctccgcaccggactgccaaagcagcgagacaagcacctgcagatcggaatccgtgaccacacggacttggctgccgttttcccttggcagtgacgaatccgcgttgtctccgctcaccgatattggattggcgatggtgagcgtgatgccttcgccttgcacaggaagtacgccattgaccatttcgtcatcctgtatggtctggttcagagaccagttcgacacggatttcgattcctcctcaacccgggctcgcagcgcgttcacgtctttggtgagggtttcgacgtttttcgtttgatcagataactgacttgacagttgcttgcgtacttccttacgtggatcggtactcagctgtcggacaaacacgcttcccgccgtgcctacggcaatgcagataaggaataccaaaacccgggtgaaccagaccgaaaacaatgacggagttttggtggccaacctcgagtccgtgtacatcacgtccatcggacgattggtcaaatcgtcaataagccgcaatgagtcatcatccagattccgccttctgcgcgaagtggatgtcacgatatcaggctgcacatgatgcgaagtcagcccggcgaaggacgccgagaaaacggcgcgccgcttcgtaggcgtattctccggagacaccgggaacgacgcacgttccggagcatcatgcatcatgtgagtcaatccttatcgttcttcagaagctggattccctgacgtatgtaaatatagccggcaagccagtacaatcccacaccccatatgccggtggcgagaccacacaaatgcaaagtatccgtagccgaattagaccagatatctgcgaaaatcaaggcgacaatggcaatcatcagcatggcggtgcctgcttttccaacgaaatgcaccggcagcggaccgtaatcacgctgcgccaaaaccagtacaagaatcgccatgatcaaatctcgcaatccgacgacgatcagcatccaccatggaatgatgtcagcgactccaagcgcgagaatactgcagaaaatcaataatctgtctgcaataggatcgaggatctgcccgattttgctcacctgattgaacgagcgtgcaatcagaccatccaagccatcggacaccgccgacagcgcaagcacaatcaatgcaagcaccatctcatggcgagagaccaataccgagatgaagggaatcgaaatgattcgcaacaggctgataaggttcggaaccgtgaaatagatatcccgcggttccggactgtactgttttttgataatcagtttgctcatacttcgagcaatattacattctcgaggcctgcaaagcggtgacgattatgccacgagcaccaacttcatacaactggtccatgagttggttgaccttggccttcggcacaacgacacgcacggccgcccactgcttgtcatgaagcggggaaaccgtcgggctttcgaatccaggcgtgatgtccacagccgcggaaaccttctcgactggaatatcgtaatccatgagcacgtaacgctgagcagtgagcacgccctgcagacgacggctaagaatcgtcaaacgatcatcatcttcagcaagacgcggggaacgaatgagcacagcttcagaatgcaacagcggttccgcgaaaatacgcaggccggcgttacggagcgtggtgcccgtggataccacgtcggcgatcaaatcagccacaccgagttgcactgacgattcgacggcaccatcaaggtgtacggtttcagcgttgatgccatgctcagccagataatcatgcacaagcttgtcgaaactggtggcgacgcgcttgccttcgatatcttcgagcttgctaatcggagaatcattgggggctgcaaaacggaacgttgaagcgccaaagccaagctccatatgctccttggcatccgtaccggagttgagcagcagatcatgaccggtaatgccgacgtcgatggtgcctcggccaacgtagacagcgatatcgagcggacgcaggtagaacagctccacgtcattgtcgggatcctccacaaccagctgacgcggattgctcctcaggcgatagccggcctcggcaagcatgttccatgcaggttcggacagcatgcccttgttgggcacggcgattctcagcattttccctcccaaaaaggccacgcctcctatggcacggccaaaaactcacagattcttgtagatgtcttcgagtgtgatgcctcggtcgatcatcatgacctgcagatggtagatgagctggctcatctcttccgcagtacgatcggcgccttcgtactcagctgcgatccaggtttcgcccgcctcttcgacaatcttcttgccgatgaaatgcgtgcccttgcccagttcgtcgacagtcagcgagccagcctgcttggctgcggccttctcgctcaattcagcaaagagggattcaaaagtcttcattattcgtatctatcctcgaaatattggtaggttcaggccttgaatgcggcttcagccttctcacggatggaatcaatggcttccgcaggatcctcggcaccatacacggcggaacctgcgaccagtacgtcggcaccggcctcggctacaatgtgcgcggtcttcgggctgacaccgccatcgacctgaatcttggtggcgaggccgcgacgggtaatctcgtcacgcagacgacgtaccttggccatctggttgtcaaggaacttctggccaccgaagccgggctcgacggtcatgataagaatcatgtcgaattcgtcgagaatatcgaaaatcggctcgacaggttcggccggacgcaccgcgaagcaagccttgcaacccatctcgcgcagctggcgcgccagacgcaccggagcgtgggttgcccccatgtggaagcttacggatgcagcgcccaacttggcatattcgggtgcccaacgatccgggtcctcgatcatcagatgcacgtcgaccggaagatcggtgacttcgcagatacgagccacaatcggctcgcccaaggtcagattcggaacgaaatgatgatccatcacgtcgacgtgaacgagatctgcattggagatggtcttgaggtcgcgctcaaggttgcagaaatcagcggacaggatgcttggtgcgatttgaatagtcatggctcttattctatgaaaggtaatcgacttgctgttatttgatgccgggctgcttgtcggtattcgagacagtttcggcatcgttggttttgatttcatcaaccgtttgctcggggaaagacaccacggaatccgaagaatcctccgattcaccgttttcaagacgctgctcgatttcggtgacggtacgaagcttctccgccaacaggtcagtgtctttgcccatttgctgcacgacgatgaatgacaccgcgccgagcacgaacaccgccatggagacccacacattgatgcgcacgcccaagaattcgtgcgcataatcgatacgcagggattcaatccaagtgcgtcccagggtgtaccacatgatgtacacggcaaacagggaacctgccttgagtttcttcatggctttggaaccgatgtatacgataatcgcggcgccgatgaggttccagatcatctcgtacaagaacgtcggatggaacagcgtgccactcgggcatgtggctccgtcatagcactgttcgctatgcccgatggcagtgccttccatgttgagtttcaaaccccatggaagcgttgtcggagcgccatacagttcctggttgaaccagttgcccaaacgcccaacagcctgcgctaccaacaggcccggagcgatggcgtcagccagcaaggccattggatagtgcttatgacggcaccatgcccatgcggccagcgctccgaacagcacgccgccccagatgccaagtccgccattccaaatgcggaacatttccgcccagtcgccatccggtccgaagaaacgttcaggcgtggtgatgatgtgataaagtcgtgcgccgataatgcccgcaggcacgctgaccagagtgatatcaagcacttggtcgaaattgccacccaactttttccaacgtgtggtggttatccatactgcaaggacgattcccatcaaaatgcacaacgcatagatatgaatcgttactggaccgatggaaaactgcgaaatcgttggcgatggaatgtatgcaagtgtcatggtttcctgatggtagtccacgcatccgatatggtgcgtggaccaccgaaatcgtcagaatggtttactttgcgacacgcgcgttatggacgccgtccgcaagctcttcggctttggcggccaacgccttgagacccgtggcctcatcgactgcgtttttcccggattcgtcaagcatggtgtgcaccaatgcggatccgacgatgacgccatcagcgtatgagccgactcgcgcgccttgttcggcggtggaaacgccgatgccaacgcagacgttcttcgcgccggcattgcgcgtgcgtgccaccaactcttccggagaagcatcgatggtggagcgttcgccagtgacgcccatacgggctgccgcatagacgaagccgcgagcgttgcctgccacgaccttcaaacggctgtcggtggagtccggggacacgaggaagattcggtcaagtccatgacggtccgaagcttcgatccattcacctgcctcgtctggaatgagatccggagtaatcaggccggcgccaccggcattttcaaaatcgcgtgcgaaacgttccacgccgtaatggtagatgaggttccaatagctcatcaccagagggactcccccggcgttggccacggtttcgacggctttgaacacgttcgcgattttctcgccgttgtcaatggcgatctgcgaagccgcttggatgacgggaccatccataaccggatcggaatacggcagaccaatctcgacggcatcgacgccatgctcaaccatggtgcggaatgctttcaacgaatagtcagaatcagggaatccatatggaagataaccgatgaatgcaggcttgttcgccgctttgaattcatcgaacatggcttccgtcggactcggcttatggctgatgccgagaggctgcccggacggcgtggttactgttgcgttcgtcataatggatactccttctttcactcgccgtccgcgttattgccctgggctccattggcttcgagcgctttggcttgctcgtcggtcagataaccgaaccatttgccggcagtgttcatatccttgtccccacgaccggaaatgttgatgatcatgaccggatgctcatatcccttggccttgagatcctcagccgccttgtatgctcctgcaacggcatgggaactttcgatcgccggaataatgccttcggtctcgcagagatccttgaaagcgctcatggcttcctcatcggtcgcccaagaataattgacacgtccgatttccttgagccatgcgtgctccgggcccacagaggcgtagtccaaaccagcggagatggaatacgtatcgagggtctggccttcggaattctcaagaagatagctcttggcaccttggaacatacccagttcaccggttcccggtgcgaagcgaatggcatggcgtccggattccggaccattgccgcctgcctcatagccgtacaggttcacgcgttcgtcatcaaggaacgcattcatgatgccgatggcattggaaccgccaccgacgcatgcacaaaccgcatccgggtgatcgataccataccaatcctgaagctgctgcttagcttcctcgccgatgatcttctggaaatcgcgcaccatagccgggaatggatgcggaccggcaacagtgcccagcaggtagtgagtgtcttttacattggtaacccagtcacgaagagcctcgttgatggcgtccttaaggatgtgatcgcccaaggtgacttccacgacttccgcaccaagcatgcgcatacgtgcaacgttcagggcctgacgacgcgcatcgatttggcccatgtagatacggcacttcagtccaagcatggcgcacaccgtagcggtggcgacaccgtgctgacctgcaccggtttcagcaatgacccgagtcttgcccatgcgcttgaccagcagggcctgaccgagtgcattgttgatcttgtgcgcgccagtgtggttcaaatcctcacgcttgaggaacacgcgggcgtcaagaccagtcttttccctcagacgctcggcaaagcgcggcgcatcggtcaacggtgacggacgaccgacatactgctggttcaatcgagccagttccttatgaaattccggatcagccttggcttcctcgtagacacgttcaagctcgtcaagcgctgtaatcagcgcttccggcacatagcgtccaccgaactgaccgaaatacggtccttcatgacttgccaacggggtttgttcggatgctttcactcttgctcctgcctttactagtcgctccacagcctgttcatggttggatgcggttgcgacaccttcgccaaccagcaccgcgtcggctccggcgcgggcataatcctccagctcaaccgaaccgaacactccggattccgctacacggatcacatcgtccggcaaatcagcggccagctcgttgtatttgttcacatcgaccttgagatccttgagatttcgtgcattgatgccgatgactcgcgctccggcattgatcgcacgctgaatctcctcgcgagtgtgcgtttcgaccagcaccgtcatattgaggctatgcgccagttcaagcaaagacttgagcttgtcgtcatccaacgcggcaacaatcagcagcaccaaatcggcgccatgcgcccgtgcctcccaaatctggtattccgtgacaatgaaatccttgcgcaacactggaattttcacggctgcacggaccttatcgaaatcgtcaagcgatccaaggaatcgacgaccttcggtcagcacggaaatcgcgctggcacctcctttttcgtattccctggccaatgcggcaggatcaggaatgtcgctaaggtgccctttcgatggcgaagcccttttaatctccgcgatcaccggaatgccatccgcttttttcagccactgtcgcgcatcaataggggccggcgcttcgaatgtctgacgcttcacctcatcaagggaaatgttctgttcacgtgctcgttggtcttcgacagctcccgccaccagttcatcgagtacagacatggtgttcctttcagcattttactcgattggttagcttgatttgactcacaactggcgaagctgcgaggcgatctgcaccgcttcgacgctggcctcggccttgttgcgagtctcctgccactcactggccggcacggaatcaagtacgattccggctccggcctgcacgctcgcttcatggtcgcggatgaatgccgttcgaatggcgattgccatatcgaggttgcctgaaaaatcgaaatagccgacagtgccgccataaatgccacgatctgcgggctcaagctcgtcgatgatttcaatggcacgtggttttggcgcaccggaaagcgttccggctgggaatgccgacgtgaacacatcgaacgacgtcatgtcggggttaactcgcccggtaacggtcgaacagatgtgcataatgtggctgaatcgtttgatatccatcaaggatacgacttccacgctttccggaagacatacacggctcagatcattgcgggaaagatcaacgagcatgatgtgttcgctacgttcttttggatcggcaagcagatccttggcaagttgctcgtcttcctcaatagtggtgccacgaggcctcgaaccggcaatcgggaaggtcatggcatggccattgtccactttgatcagcgtttccgggctggatccaataacgttgaagtcacgcccctgcgcatcggtcaacgacatgaaatacatgtatgggctggggttgagcgtacgaagcacgcggtacacgtcgaatggatcggctggcgaatcaatgtcaagacgctgggaaatgaccacctggaacacgtcaccatcgatgatgtgctgcttggcgatttcaacggaacgctcataatcgctcttctccgtacggaaacgaagctcgggctggctaatggtctcatccaacacattgacgcgagcttcaccttcgacaggcgtggcggccttacgctgcatatcatccaatcgcgccaccgcctcgtcgtatgccgcatcggcacgggtggatcgatcgtctacgttcaccgcattggcgatcatccataccgatccggacacatggtcgaccacagcaatatccgtggccaatgccagaactgtttccggctgcccggtctcgttcggcgcctcggcacgcaaggtcggttcccaatggcgaatcgcatcccaaccgacggtaccgaccagaccactggtcaggttcggcagtccttcgacatgcggcgctttcagtgttttcagcgcagcatgcgcgacttccatcacatcgccttcggtaggcacgcctgcgggaacctgacccaaccaatcggccttgccgttgttggaacgcaactgagccatggaattcacaccgatgaagctgtatctgttccacgtgccgccaaattccgcggattcaagaatgaatgtgccggaacgtcctgcagcaaggcgttcatagaatccgacaggagtcaacgaatcagccagaagtcggcgcacaatcggaatcacacgatatccctgatcagccaattcgtggaattgttcgcgactcggccaggtggcgccccacttgagtgcttgtacgctgcattcactcatcgctggccctcctgttccttggtacggtatcctacgaccacgggcagttgcccgccttcttcgaagcaggatcgtttgccggtatggcaggccgctcccacttgatcgacttcaaccagaatggcatccccatcgcaatccagtgcgaaggacttcacatactgggcatgtccggaagtgtctcccttgcgccagtactcctgcctggacctcgaccagaacgtgacgcgaccagtcatcagggtgcgtcgtatggcttcgtcgttcatgtagccgaccatcagcacttctttggtgtcgaattgctggatgacggctgccaccagtcctttatcgtccctcttgagacgttctgcgattcgtgggtcaagaatagtgctgttgtcgtatgcttcgttggtcatgatggtgttattgatttggttcttcgattattgattacgttattcgcctgttttgcggttttcggctttcatcgcacggtatagccggcggccttgatggcatccttgacttcgccgatggtgactttgccgtaatggaagatcgacgcggccaacacggcatccgctccggcttcgatcgccggggggaaatcggcagccttgcccgcacctccggaagcgatgatcggaatcttcacttccttacgcacggctttaatcatttccaagtcaaaaccctgttgggtaccatccgcgtccatggaattcagcaggatctcccccgcgcccaactcctgagcacgcttgacccaccagatagcgtcaatgccggtggatttgcggcctcccatggtggttacttcaaagcccgactgagtgtgtcgctcgccctgctcacggcgtgcatcgacggataatacgagcacttggttgccgaatcgttctgcgacacggccaatcagcgtcggatcattgatggccgcagtgttgactcctaccttgtcagctccgcaacgcagcagagaatccacatcttcaggggcacgtacgcctccacccacggtcaatgggatgaaaatctgttcggcagttcgactcaccacatcgaccatggtctgccgatgcgagctcgaagcggtcacatcgaggaaagtcagttcgtcggcaccctgacggtagtattccgcggcaagttcaaccggatcgccggcatcgcgaagattctcgaaatgcacgcccttgactactcgtcccgcatcaacatcaagacatggaatgactcggactgccagtgacatgctgttttactccttcgcgcataatcatgtgtgcaacgaatgcaagagtaaccgttttacgttacgcatgttcgtcggaagtccgagtagcggacagaacaagcatctttccttgaaatctaatcttgttccttagctgcgagctgcccgcatgcaccatcgatatcctgcccgcgcgtgtctcgcaacgtcgcagtaatgcctgctttatgaaggatatcaaggaactgctgttcatcctcaggcttcgaagcggtccatttcgatccttcgatgggattgagcggaatcggattgacatgagcccaattgtcaccgtaatggttcaatcgcttagcaagtaatttggcatgctcggcttgatcattgataccgcgcatcagagcatattcgatgcttacgcgacgtttcgaagccaagtaatagtcatgtgccgcatcaagcacctgcgtagtattgaaacgcttgttcattggaacgagctcgtctcgcaactcatcgctcggagcgtgcaaggacacggccaaacgcaccggaatgccttctgccgtgagtttcttgatacctggtaccacaccgaccgtggagacggtgatgttgcgtgccgaaatgccgaaaccttcaggtggcatggcgctgatttggcgtacagagctcaatacggacttgtaattgcccataggttcgcccatgcccatgaacacgatgttgctcaggcgcccgagaccaccagcgacttcgccgtcgtgcatggctttcgcggccacacgaacctgttccagaatctcgcctgccgacatgtttctcgtcagacccaattgacctgtggcacagaacgggcagcccattccacagcctacctggctggaaatgcataaggtggtgcgggtgggataccgcatgagcacggactcaataagagaaccgtcgaacagacgccatagcgttttgatagtagtgccctcatcggccacttgacgggtcacttcggtaatgagcgttgggaaaaacgcctctgcggcttcggctcgtttcgctgcaggaaagtcagagaactcttcggcagcgacgtcgaaatgcccatagtaatgattggcaagctgcttgactctgaatttcggaagtccaagatccttggctttcgcgatacgttcgtcttcagtcatatcagcaaaatgcagcggcggcttgcctcgacgcgcatgatctttggaaagcacgtcgcggaaggcaccggtagtgcctcctggagtaataccggtttccggcaaatccttcgtggaattcacggagtcgctcatgcttgtgtttgcctttctcacattccagttgcccacagcagcacgcacacgaacggcgcgcacagcagaatggaatccacacgatccatcacgccaccgtgtcccttaagcaggtgtcccatgtccttgatgccgatatctcgcttcaacatggatgcgcacaaatcgccaaacgttccggcgatgccgatcatgaaaccggccacgacagggacccaccagcgggaaatccacacatccgacccgtacgtgcagaacatcacggcaaaagatccgatcatggagaacagaatggaacctgcaagaccctcccacgatttcttcggcgaaatgcgggggcttagcttgtgcttgcccagccatgccccggcgaacaaaccaccggtatcgctcaacgcgggcatgaataccatcataatagcatgcgcgacgggatgatcattgaatgtcaacggcatgatgaggcaggaagccagaagcggaatgtacagcacggtgaacatggagaccgcgacatggctcagcctgctatggcttacctctccctgctcatggttgaaggaggattcaagtcttgcgcctgcatcggtgtgggaaagcttatccgccacggccagagagatgcggctgccgaacgtcactttagcgctggcggcgatcgctacgaccaccaaagacaccagcacgcataccgtcatggcgacgatatgacgttcgctgtaataggtggacagcaacgtcgccgccgaacatacccacaacaccgccacgggaatatgaagtcccgcagtggcgaaatcgacgcgcagctcccaaagggcaagcaccatgaacagcacaaccagatagacgaacaagtcaatgctgatcagcagacacgccaagatgaggatgacgagcaccgcccctgtggcgatggcctgcggcatattacgccccgtcttcttgttgatggcgttgatggcctcttcggtttctttttcgagctgttcctgatgttccatcatgttccctgtctggctgtgcgtcgattcttttcaggagatgaaggtctctcagacctccatgatctccttctgcttggcttcgagcagggtatcaagttcatcagtggtctgcttggtgatcttgtcgagctccttgagcagacgatcgccctcgtcctcacccatctcgccgtccttgatggccttgtcaagggattccttggccttgcgtcggatgttgcgcactgcgaccttgccatcttccgccttgcccttggcgagtttgacatattccttgcgacgttcctcggtcagctccggcatggtcaggcgaatgacgttgccgtcgcgacgcgggctggcgcccagatcggaatcacgcaacgccttctcgacggcattggcctgggacgcgtcaaacggagtgacggacagggtacgcggttccggcacgccgatggtggcgacggccttcagcggggtcggagctccataataatcaacggtgataccgttgagcagcgccggattcgcgcggccggtacgaatgccggagaagttctccttggtggattccacggacttggccatctgtgccttggcctgttcgacaatagttgccatttgtactccttgttgttggttgtttgatcgatattcgacgttgaatgtcgttattcagcgagtgtggactccgcggtggaaaccatagttccgatttcctcaccgagaagggcgcgggtcacattgccattgccttcgagcccgaaaacacggatgcgctgcttgttgtcgcgggccatggaaagcgcggatgcatccataacggcgagattgtcgacgagggcacgattatagctcaatgtggcgaaacgcttggcgttctcgtccttacgaggatcggcggtataaacgccgtccacgccgttcttgcccatcagcacctcatcgcaatggatttccaaagaacgctgaatggacacagtgtcagtggagaaatacggcataccggcaccagcgccgaaaatcacgacacggcccttctccagatgacgaatggccttgagcggaatgtacggctcggcgacctgacccatggtgatggcggtctgcacgcgcgtggcctgtccctcctgctccaagaagtcctgcagagcgaggcaattcatcaccgtgcccagcatgcccatataatcgccgcgggagcggtcgattccagcctgttgaagttccgcgccgcggaagaagttgccgcctccgacgacgatggcgacctgaacgccctgctgcaccgcgggaacgatttcctcagcgatacggcggatgacggacgtgtcaatgccgactttgccgccgccaaacgcctctccggatagtttgagcagcactctgcgtggattatcaccagtgttttcgccagtcatgaaaagcctttcttgcccgagaactcacgaaatttaccgctctcaagagtatcggcaaacacagacaccacaccgcaacgacacagcgtcgagaagaaaacaaagttggccatcaccctgtggatgatggccaacctcatggaatctctagcgtctaacgcacggattcaccattgaagccgaattcactcagcctcgcccttgccgacctcgacacgagcgaaagccacggctgcgccgccgacttccttgaacaggtcgccaacggtcttggacggatccttgacataggactgctcgagcaggacgttctccttgtagaaggcattgagacggccttccacgatcttcggaacgatcttctccggcttgccttcggccaaggacttctcggtggccacgcggcgctcggactcgaccacatcggccggaacgtcctcgcgggtcagccactgggcacccattgcggaaatctgcagagcggcttcgtgagccacagcagcgccggcctcatcggtggcgatcatggccacgatgctcggcggcatctcagcggacttcttgtgggcgtagatctcaacgtgtggaccctcgaccttggcgaactggccgaccttgacgtgctcaccgaacagagcggccgcctcttcgacggcttccttcacggtggcttcgccggaagcggctgccagcacttcgtccacagaagcggcctcggctttgacggcgtcttcgagcacgctgtcagcgaactccacgaacttcggagtcttggccacgaagtcggtctcggaattcagttcgacggcgtaaccggtctggccattggcggattccacgacctgggaggcgatggtgccttcctgagccttgcgaccttcgcgcttgccagcggcctggatgcccttggcgcggatgatttccttggcgcgagccacgtcaccctcagcctcggtcagagccttcttaacgtccatcatgccggcgccagtttcctcgcgcacctgcttgatcagagctgcagtgattgctgccattgatttgtctcctctgaaaaatagtgatgccccatatgatgggaggcacaacacctcccatcatagtggatattttcactcagccttggcttcgccttcagcttcggcttcggcttcagccggtgcatcggcggccggagcgccctcagtgaggagctccttctcccaagcggccatcggctgctcggtctcgccctcagccttagcggccttgccggaacgctccagcaggccttcggccactgcgtcagccatgaggctggtcagcagttcgatgccgcggatggcgtcatcgttggctgcgatcgggtactcgacggactccggatcagcgttggtgtcgacgatggcaacgaccggaatgcccagcttgtgagcttcctcaacggccaaagcttccttgttaacgtcaaccacgaacatggcggacggagtacggttcatgttgcggataccgcccagctgcttagccagcttgtccttctcgcgctcgagaagcagcagttccttcttggtcagaccggaaccacgcacgtcggtgaagtccatctcttcgagttccttgagacgggagacgcgcttggacacggtctggaagttggtcagcataccgccgagccaacgctcggaaacgtacggcatgttcacgcggacagcctgattggaaacggcttcctgagcctgtttcttggtgccgacgaacagcacggtgccgttgtgagcgacggtagccttgatgaagtcgtaggccttgtcgatcatgtcgagcgacttgaacaggttgatgatgtggatgccgttgcgctgggtgaggatgaactgcttcatcttcggattccaacgacgggtctggtggccgaagtgcaggcctgccttcagcatgtcgctcatattgatctgagccatggtattactacctctttctgtcggttcttgcctggtcatgcgttcctgcgtgcagccaaagccttgcggcgtcggccgaccgacacaggtcgtcgcgaacatgacgcgaattggttgtatgccggttgacaatattgggtggctcaggactttcacgacaaagcccttcgccggatggcacacaaggcataaaataccatggggtcacgtcttttcgcaaagacgtgaccccaagtcgtcatatcggtgagatgcgaacaatcacttgtggtgattgcgcatgtagcgcatcgcctctcggcgttcctctttctccaaacgatcaagatagacatgaccgttcaagtgatcggtttcatgctgcaacatgcggcccataatgccacgaccttccagcacgaccgtcttgccttccaaatcgatgccacgcacacgagcgtaatcggcgcgacgggtcttgtaccacaatcccggcacagacaggcatccctcatctccgtattgttcaccgctggtctcttcgaggacagggttgagcacatacccgatcttgccgttgatgttataggaaaatgccctcagattcacgccaatctgattagctgacaagccagcccttcctggatcgtcaacggtatcaagcagatcctgtaccagatgacgcacggccggcgtaatttccttgataggatcacagggggtacgtagcaccggatcaggtacgactcgaatctcacgaattgccaagattatcgctcctcgttcatggttgtttcctcagtttccgatgagtcttccggcgtttggaactcgccggcgtcttcggtctgcttcttaattttctcctgcatggtatcaaatgcctgccgaaccttcggacttacggattcggaagcctgacgcatggattcggaagcctgcttgaccgtttcggtggttcggtcaagaatctgcaccgtctttggcagcggtttgttggatggcttcggcgcatacagcacattgtcgatgacattttcgtaccgcttaagcaccttcggcctgacaactttcaggctcgccgtcagagtgcccttctcctggctgaactcctcgtcgaggatttcgaacttgcgaacggattcagcacgagagacattcgcattcgccttttcgacatactgctgaatgaatgcgcgcacggcatcgttcttcgcgatctgctccatgggcatgttgctatcaagtccctgctgtgcaagccaggaacgaaccatctcctgatcaagctcaatcaaagctccgatgaacggcttgccatcaccgaccaccacaccatgcgacacgatcgggcaagtgttgatgacatcttccataggtgccggactgacgttcttaccgccggccgtaatgatgatatccttcttgcgacccgtaatgtacacgaatccgtcgtcgtcgatggttcccaaatcgccggtcttcagccagccatcagccatcttgacatcggctgtcagctccggcttcttgtagtagccaaggaacacgttggggcccatcacctgcagttcgccgtcgtcatcggtgcgcacgcccatgcccggcccgggcttgcctacggaaccgacgcggttggcgtcctgccagttgacaatcatgggagcggcggtttccgtcatgccatagccctgaatgaaggtaatgccatccataccgttgaagaaatgggcgagatcgacgttcaaaggagcgccgccacaagccagatatctcatgttcggacccaaagcagaacgaatggatttgcctacgacagacataaagaacgaatgttcggcacgagccacaatggaatggcgtccggtttcctgctcgtccttcgaccattgcacaaaatgatcgaaagccttggcgaacactcttccacgaatacccgctccggccttttgcgaagccgcgttatacactttctcgaacacacggggaactcccagcagataggtcggcttgaagctacgcagatcggcaagcagatgcttggctccgggcagatagccgaccaccccctgcccgccaatcgcaacatactgaatatagcgagcgaagcagtgcgccaacggcaggaacaacatcagacgattcggctgatatagcatttcatcgagaatgatgtagccgttcagcacgatatgcgtgaaattccggtgagacagcatcgctcccttgggcttgccagtggaaccagacgtgtacacaatggtgagcatgtcatcggccttgaccctggaaatcacctgatcgagcgtgtcctcgccgacaccttctccaaaatcagcaacggcatcaagaccatccgccttgaagttgaagacgtagcgcaggctgctgtgctcatcgcgaatctgttcaagcgtttgtgtatgcgcgaaatcaccggcaaaggcgatgatcggatccacctcttcgatgatggacgcggcctgcctggcggaatcggtttcatacacgggcacgcttaccgcgccgattgcggcgcaggcaaaatcgatgactccccattcgtagcaggtaggcgaatagatgactaccatgcttccggccttgacccctaggccaagaagacctttcgcaaccgcgcgcacacgctcaagcatctcccccgccgtaacgtcatgccatcgacgagtctcgtcgtcctgccattgggcgatgagatcatcaggatcacgtttagcgcgtctggagagcagtgcgaaaacggtatcctcatccgtagtgctatacgcaggttccggtacaaattctctcaacatgagtccctatagtagttgcagtatgctcaaggcacgctgaaaacccttgaaaacggctgaattcagccaattccaagggttttgaatggttacttgttatacgtcacacgccgaaatcagcgacttcgcacttccaagcagatcccttgaggacgcacttcaaattgctgcacagccttcgtcctccaatgcccatcagcacggtgctttcgaagcatgtcggagagaccaaccagctgtcaacgtaatatacggtgatcggaagcagacccaactgcgcgtatatcctcacatccttcttcatctgtgctgcgatctgagcggaggcatttctcagctttctcatgcaggcctcgctcaataccctttccacgcgtgcttctttctgcctgccacggaagatatcgacaacattgcagatcaactgcgccgcgaacatgttcatggaataggcaaattcagcatcgcacggcccaggcattatctggatgtaatggaatggtattttcctgccgaaaagatctgaattaagaaacccatcatacgagggaagcgttttatcgtaatcgaaaaccggctttctgccaagctcaagagatatcctttcccactctgtcaggttttctccctcgcgtttcttcccacttttatcagcgcgcttcgcattggccgctgatccctggtcagaaggtggaacctccgagaagggctcgttagcctccggcggcggaacatcattttcacatgaatcatccatgatgaatccctttcttattcgcccgactcatcgttgagagggggtgtaagaaccattaaggcacaaaagccatcccccgtcaagttgacatttgattcttgtggataagtggataacttcagatatttcaaacactttagaacaccctaaagataaattttatacccctaaaacattacaaaaaaggtggcatatcgttgaaaaagcaaagagaatccttctttggcgaaaaaccctaagttcgtctcaaaaacgcttagtaaaaatgaacggcattagccttcactgaaagataatgatcatgtttgttcgtatatgctcacataaagttatgttaccgggcatacactcctctaagtgcgctcaagaaaaataaaaaaaaattggctctgcggcattcgccgcagagccgtctgagaatgggctcccccacctggactcgaaccaagacaaagggttccaaagacccgtgtgctgccattacaccatgggggaatggcggaaaaccttgcggttaccgccaagtgtctattatgccacatgtcgccaacaccgcgtgtctcgacgtgtcgcactaataaaaaacgttgtttaaggtgcacaaaaagtgttatgcgcaccttaaacaacggtactcgcttcactgatatgggagttaccccacaaacatgcggaacgtacgctaagcatgcccgcacaacgcgtcatcaggcgaacaagaagccctgtccgtgatgctccggatatgtgtcgaacaactcagccacagagccgtcttcgaacacagcacggatggcgctggccagcagcggcgcgatcgacagcacggtcaaaccgtcccaacgcttctcttcaggaatcggcacggtgtcggtaagcacgacttcgcgggctccgctgttcttcaaacgttcgacggcgggaccagacagcacgccatgtgtggcgacgacagtcaccgacttggcaccggcatccttaagcacgctgcatgcaccggcaatggttccggcggtatcgatgagatcgtcgacgagcacgcagtccttaccttcgacatcgcccacgactcggttggcgaccgcttggttcggacgggtgatgtcacgcgtcttgtggacgaatgcgagcggaccaccgccaagacgctgcgcccactgctccgcaacacgaatgcggcccgcatccggagagacgacggcaacattgtcaagctggttggagaaacggtcgcgaatgtagtcgaccagcaccggcatagcgataaggtggtcgacaggaccgtcgaagaagccttgggactgcgccgcatgcaggtcgacactcatgatgcggtcggcacctgcggtcttcagcaggtcgaacatgagacggcaggaaatgggctcgcggccgcgatgcttcttgtcttggcgcgagtagccaagcagtgggcagaccgcggtgatggaacgcgcggatgcacgcttgagcgcatcaatcatgatgagctgttccataatcgattggttgatcggggctgcgtggctttgcagtacgaacacgtccgcgccacgcacggattcggtgtagcgcacgtacatttcgccgttggcgaagtcgtatgctgtggtttccagaacatcaatgccaagttgttcggcgacttccgccgccagtttcggatgtgttctgcctgtgacaaggataaggtttttatccggctttccttcaaggattgcgctcaccatgtctccaaacgtctgttttcgcgtcaagtggacgtgacccatattaaccatctgcgcagaccgtctcacccgcgcgtgttcacctgaaatttaccggtacagtccgtgcttgccaatatattgcaccacgccgtccggtacgaggtaccaaacaggctccccatgctccgcacgtcgccgcacatcggtcgaggaaatcgccagtgccggtatttccaacgtatcgaccttgccttccggcagtttcaccccttccggcgatgagtacccggggcgggtcacggccacgaagtgggccagatcccacattttgtcggcgtctttccattgcatgatttccgcgaccgcgtcagctccggtgatgaagaagagttccgcgtcgggatgttgcgcacggatgtctcgcaacgtgtcgatggtataggtgactcccggacggtcgatgtccacgcgtgatacggtgaatttcggattggacgcggtggcgatgaccgtcatgagataccggtcttccgcgttggtgacgttcttgtcgagtttgaatacggggcgtcccgtcggcacgaagatcacttcgtcgaggtcgtacacccacgacacttctgaggccgccaccaagtggccgttgtggatggggtcgaacgtgccgcccatgatgccgatgcgaggcctgctatgccagttgccgcgtgctgaacgtcggcctgtggccaccgcggaacctgctgattccacggaaaggtcggacatgcgccgttccggttccaccacatagctgatggcaagttcggaatcggcttcggcggattcgggccgcatgcgtttcgggccggtcatgaggcatcctcgtttttttgttcctgatcggcgtccgcggtctcacggccgatgctgtctgccgttggcgatgcgttgtccgggtcgattttgcccatatcctcatcccactcgtcctgcacgacgcgcctgatctccgcgaaagtcggcagagggaagtccggctgataggcgcgacgcacttccgccacacgttcggtgacgcgaatcagcgtatcggtcatgccgtcaatatcctgttcgcgctccatggcgctgaatttggcgatgtactgttccatgagccgcatctgctcatcgacgcttttaagcttctcttcgtcgagttccaccacgtcttcggcatcgacttccggccaaccgatcagcaccgcgtcggcgtattcgagtgaagcacgctgtgccgccgatgcgatgccgtcctcgatctgcacgagaaacacgtatcgtacgatgcttaatcgttcggatgcgagcttcaatcccagataggggtcattgagatccgcattccatgggttcttagcgtcagtcattgtttcctccatctggccgtcattattgttgtgttcgttcatgcccgtacctggcctgttccgtagccgatccacttggtcgtggtcatttcgcgtagtcccatgggcccgcgtgcatgcattttttgcgtggagataccaagttccgcgccgaagccgaacactcccccatctgtgaaacgcgtggacgcgttgaccatcaccaccgccgagtcgatgcgtgaggtgaattcctcaatggccgaatagtcttcggcgataatggattcggtatgccctgtggagtggcggttaatgtggctgatggcctcgtcgagtgagtcgaccactttgacgccgatcttcaacgcgagatactcggtatcccagtcttcctcagtggcatgtatcagtttcaccccgtcaataccggttttgtcgatgatctcgtaggcctgttcgtcggcatgcacttcgacgtcggctgcggcaagcgctgtggcgatttgcggaaggaacgcttcggcgatgtcactgtgcacgaggagtttttcagtggcgttgcagacgccgacgcgttgcgttttggcgttgagaatgatggggatggctttgttttggtcgccggttcggtcgacgtagatgtgtacgttgcccgctccggtttcgatgacgggtactttggagttttgcacgacggcttggatgaggcccgctccccctcgtggaataagcaggtcgatgtggccttgggcctgcatcatggcgttggcgccttgacgcccgtattcgtcgacggaagcgatgagtgcggcatcatatccgtgttcgtgcaatacgtcggcgatgatgttgagggtggctgcgttggtgcgttcggccgcgtgtcctcctctgaggagtgccgcgttgcctgatttgatgcagagtgacgcgacgtcgacggtgacgttgggtcgtgcttcgtagatcatgccgagcacgccgatgggcacgcgggtttgttcgagtcgcagaccgttgtcgaggtggtatccgcgcacgatttcaccgatcggatcctgtagggtggctacgtggcgcacaccttgtgcggctgcgttgacgcggggtacgtcaaatttgagccggtcgagtttgcctgcgtccatgccatgttcggcggatttctgcatgtcgatggcgttggcttccgcgatttcattggcgcgcgcgtcgagtgcgtcagcgatggcgttgagaagttcgtttttacgctgcgtgttggtttgggcaagttgcgcttgcgcgattcgggcggcgtcggctttggcgcacacctcgttgagcacatcgggctccatggcgttggattgggtctgtgggttcgtcataatttcctagattagcgcgaaatcgcgccttgttccgtagcttcgaccattatttcgtcgtagcatcggaaacagggcgcgatttcgcacgtcacgtgtcctcagagatttatatccgaaaccgttctcgatcaaccgttattcgacatggaatcagtggatctgatcgagacccggatacagcgggaagtcttcggcgagcttgtcgacgcgagccctgagggcttccacgtcggcatccttgcctgctgcgagtgcggttccgatgatgtcggcgacctcttcgtattccttgttgccgaagccgcgggtggcgagggcgctggtgccgatgcgcagaccggaagccacgcttgccggacgcggatcgaacggaacggtgttgcggttgatggtgatgccgcactgggcgaggaggtcttcgccctgctggccgtccatttcgctgttgcgcagatcaaccatgacgaggtggacgtcggtgccgccggtgaggacgctgatgccgttgttcttgacatcgtcggacatgaggcgttcggcgaggatcttggcaccgtcgagggtgcgctgcatgcggtccttgaactccggagaggctgcgaccttgaacgcgacggccttgcctgcgatgacgtgcatgagcggaccgccctgctgacccgggaagaccgcggagttgagcttcttggcatagtcctgcttggcgagaatgaaaccggaacgcggaccgccaagagtcttgtgagccgtggaggatacgacatcggcgtacgggaccgggctcgggtgcagtccggccgcgacaaggcccgcgaagtgtgccatatcaacccagaacttggctccgacttcgtcggcgatttccttcatggccttgaagtcttcgatacgcgggtaggcgctccagccgccgatgatcatggccgggtgggtttcaagcgcgcgctggcggatgatttcaggatcgatgcggaaggtttcaggattgactccgtaggcttcggcatggtagaaacgtccggagaagttgattttcatgccgtgggtgagatgtccgccatgatcgagggcaagaccgagcacggtgtcgcccggcttgacgagcgcctggtagacggctgcattggcctgtgcgccggagtgaggctgcacgttgacgtattcggcgccaaacaggctcttggcacgctcacgggcaatggtttcgatcttgtcaacctgctcgcagccaccatagtagcggcgtcccggatagccttcggcatacttgttggtcagcacggaaccctgagcctgaagcacggcacgcggcacgaagttttcggaggcgatcatctccaagccgttctgctgtcgagacaactcagcgttgagtacctcggcgatttcggggtctgcttcggcgataggcgcgttgaacatgtcgttcggagtttgcgcgagaggcgatgcggtcattgagctctccttggcttggaggataaatacgttgcccgtacgaacgtgcaggcttaacgatgaagtgtacgtgcacaaatcgcatgagggaatagggcgtttcgaaacatggaagcaatcacgaaacaagcaggaaacaatcaccacccataaacacgcatcgtcccattccacggacgccaaacacgcttcttcccgcccataacgctacactcaatattgtttgacgttcattgtccgttctattgctaaggaaatccagtgaccacgttccacagcactcgcagcaccaccgattcactcacctccaagcaagccatacgcaaaggcatcgccgacgacggcggcctgttcgtaaccgactcactgggcgaaacccacgtagacgtcgcatctctcgcaggcaagccctaccagcagatcgcattcgacgtgctgagcgtgctgctgcccgacttctccgaaaccgaactcaaggcatgcatcgatgaagcgtacggcgcgcaatggtccgacgaaaagatcaccccggtcaagccgctcggcgatgactacgtgatggaactgtttaacggcccgacctccgcattcaaagatgtcgcattgcagatcctgccgcgtttcatggcacgcaccaccccggccggcggcgacggcaacgagaaaatcatgatcgtgacagccacctccggagacaccggcaaggcggcgctcgctggtttcgcggatgccgagggcacaggcatcaccgtgttctatccggaaggcaaggttagccaggtacaggaactgcagatgagcacgcaggctggttcgaatgtgaatgtctgcgcggtgaagggcaatttcgatgacgctcagtccgctgtcaaacgcattttcggtgatcgtgagcttgccaatcgtttggcttccgattcgcatgtggtactgtcttccgcaaattcgatcaatgtgggacgtttggtgccgcaggtcgtctattatttctccgcttacgcgcagctgctcgaacagcaggtcatcaatgtcggtgatgaggtcgagtttgtggtgccgaccggtaatttcggcgatattctcgccggatattatgcgaagctgttaggcttgccggtcaagcatctggttgttgcgtccgataagaacaatgtgctgttcgatttcctgacttccggcacgtataaccgtcagcgtccgttctatcagacgatttccccgtcgatggacattcttatctcctcgaatctggaacgcatgctgtattacatgtccgacaaggacactcgtctgatcgccatgctgatgaacgatttgaaccagtggggcgcctatgaggttcccgaaccgatgctggccaagattcgttccctgttcggcaccggctgggccgatgaggatcaggtgcgtgagatgatcgcggattgctggaacaagaaccattatgtgatcgacccgcataccgcgtgcggttattacgtgatgcagcagatgcctcgcgatccgctgacgccgcgcgtgctgctgagcaccgccagcccgtacaagttcccgcgcgtggtcaacgagtccttgggtttggatgcttccggcacggatttcgaatgcatggacgtgcttgccgaggcgaccggcactaccgctccggccgcgttgcgcggtttggagaccgccgacgtgcgtttcgaccatgtcgttgacatcgacggtatggaaggttttgtcgagcaggccgccaaagctctgtaaaaactctgtaagcgaagcatactttcacatcgttaaagccatctccatcggccgtccgcaatatgtggacggccgtttttcgtcaaggctgctacagttgcatgctcggaggcgaacaagcatgacagcaccaacgatacccgcatctgaatcggtacgacagaagcaaccggcacaacaatcgaaccagcccgaacagccccggcgtaagcatgatcgtctcatcacccgtgatatggcgttggtcatgcttgcgacgttctgtttcatgtcgagcaatatgcttgccaatccgatcgttgccggatatgcggaatcgttgggcgcggacggcatgctgatgggtgcggcggccgggtcgatgagtttcatctcactgttctgccgccctatcgcaggcaatctttccgacaaaaccagcaagcgcacacttgtggcggttggcacggtgctctatttcgccgccggactgctgtactatttcgcaaactcccccatcatgctcatcatggctcgcgtgatcaacggcgttggtttcgcatgctgctcggtctgcctggccacgtggatgtcgcttttgctgccgatccggcatatgggtgccggcatgggattgtatggcacgatgaacgcgctggctatggcggtcggaccggcattgggtattcgcgcgcaaaaatacatcggttatcgtctgacgtttttgagttcgctggtgctggcggtgatcatgctgctcgccacactgatggtgaagaatggcggacagccggtacgcaaaaagcagacttccataacggagaatccctccactgccgtagacattgacggttctgctagcgcaaccaaaaagcatcgtttttcgatccgttcgattctagaaccgcgtgtggtgccgttgtcgctgacgttcatgatgtttgcgatagcgtatttcgcaaatcagtccttcatcgtgagttatgttcagtctcgtcatctgccggtatcatccgacctgtttttcatgttttacgcggtcgcgttattggtgttgcgactgggcttgcgcgacctgttcgacagcaagggcttccgtttctggctgacggtctgctcgttgggcatgctggcgatgctcgcatgcatgacgttcctgttcaatgattggatgctgttgttggctgcgattttcaccgctgtcggctacggtctgatgagttcagtcacgcaggcgcaggccgtggtaatcgcaggccgcgagcgcagtggtattgcgaatagtacgtattatgcgggtattgatttgggtatgtcggttggtccgtttgtgggtggtttggtgtatgggcatttgcctgctgtgtggttttatccggtgtttatgttggcgatgcctgttgcttggttgatttatttgttgtgtgtgaagcgtgtttcgcggtagttgttggcatcgtgtgcgaggtttctgccgtaaaccagtccaagcgcgtgtcgttctaactgtttttgcggtcggtcgtattttccatatacggcaatatgaccgaccgacgcccatcctggctcgtgcaaggcgtccatgccgaaggggagatgtcaggatcggtccttgccgccgtattccgttccagcctttccggctatttgacttggtggattttgttgcctttgaccatgtaggcacgtcgggccatgtcgatcatgggctggtcgaatcggctgtctgtgtagaattcgtccactcgaacgttgtctccgtagagttcgcggaatcgtttgggcttgttggtgttgaagttgaggtagtttacgttcaacgtgttgccgtcgatggtggacgagaccaaatgttgcacgccaagcctgcggcaggcctcgcccacggtgatgtcgaacgaggcggtgaggatcgcatcgtcttcgcgtggcttataccagggtttgatgcgcttcatgttctgatcccagaaggcgttgaccaattcttcgaattccaacgattcggcaagttcgcttaaatatccgtggcatagcttgcccacaccgtattccatttgatcgaacgtggctcgtccgagcttgtatttgacggcatagcgcagtaccggggcgatgtaccgcaatactttcggattgtatttggccgaaaacaggtacaggtcgaacaggctttctccgtcatagatggttccatcgaagtcgaatacacgcatgtatgcagctctcacttcctcgtatgcgcgcattcaatacgcgccattgcacctcatgctaaagtccgaaggctgattccttcttacaccaaggtgaacggccggcgaccgcaatgtgcacaaattgcacatctcaatgcacattcggttcatgtcacgtttggaaggaggaaccaccacaacaacacagtcggaccgctattcgccccataggagccgttcgcgctgctgatactcctcatcgaacaacggctgggccttcgtgtcgatgagcttggcgaattccagatcctcatctcgttccacccgatgctcagccatattccattggtcatggtacgtgtaacgcaatgcctcggcatccgttttcagaacatgcgaccggtaaaggtcccgttcgaatagaagcgtatcaaccagccatcctggctcgtccggaaacttactgatgccattgacgtactccgcacgatacgcgtcatggacaaggacaggcaacgcatcgatacgcaaaagctccttgaacatgataagccgtccgattcgaccgttgccgtccgaaaatgggtgaatcttctcaaacgtccaatggacacgggcgatctgatacggctcgtcctcaagtttcgtgcacatatcaaacagcctgtccataaattcgggaacatcctgcggcagcgcggtccttgtcggagtgacaggattgccgataaagttcggccgagtcttgtagccgcccacgttgaaaagcgagtcggagacctgtctggtgccctgcttgagaatggcatgcaggtgacagaccatatcccggtccaccggctcatcagcatggtcgagaatccaacggaacgcagcaaaatgattacgggtttccaacgcatcatcaggattgacctgttcgctgccatccgtggtataggtaccggtggcaaatagctgcgcggtctgtttggcagtaagggtggaaccttccatatgattggaattccatgcgaactggatttgcgtggtcgtgtaaatgccgtcaccatatcgagtatcacgctctcggataagacgctccacgatacgttccgccataaccccatccttccttcattccgctcgactatcctcccatggtaattcattttaggctagaaaccgtggtggatgtcgtatatcctgcaggttggttccatgtcgaacgtgaccgtgtcgaactgttcgggatggtgtacgaacgtatcgatcagtttccattggcgacggctgatgccgatacgatagtccgggcggaccataagcaccggcgctttcggctggagttcctccaagagctgcgcgcgctgttcgaagcattcatcatcgtcgatccatacgatcggcgcgggttcattctcttcgcattcgatgcgtacgcgtcgttggatggtctgccatttgcctgtctcacgtccccatttggtgacaggatcgtaccaggtgatgacatcgaccagcatgggatcccatccgagcatcgggtcgagaatctgactgcagtatggctgccaggtggacagccaccacaattccacaatgccgtcaactgccaacgcgtacatggcgtcggatagttcgctggaccagtggatgcgccatgagcctacgggcgtgtgggctttttcgttgccgtccaagtggaacgctttttcaggattgtacattttcgcgtagggactgtcgggcttcgcccaggtcataactttgttcacgccgcccctgcgcaaaagcttgtcatccggaaaggcgttgagcaccccatcgaaatccgtgaacaccacaggcttggaaaacattttcaaatccgtcatcaccactcccctttcaatcatcaactatcttcttatattgaccttacggtttcctcattacgttttacctgacaaatactgacagcaccgccatcgttttatttgctatactcggattggttcggcacggacgccgaacgaccgcaggcacgagcataggcaaccgcaaacatggtccatagatgcgcaaaacatgatgcgcggacgcatccaaaaaagcggtcaccatcacgcaaaggagcgaaacatggcagacgaatcatcgaagattccagagaaaaccgtcgaacaaatcttcgacgaacgttatcccctcgacaaatgggaggattcaaactactcgatactcgacaaattctcaatgcgcggccgcaaaggcttcgtcaccggagccgcaggcggtctaggacgcaacgcggcggccgcgctcgcccaagccggagcagacgtcgcactagtcgacctgcccagccaagaagacaagctcaccgaactggcgaaagacatgagcgaacgtttcggcaccaacgtcatcgcgctcacctgcgacgtcaccaacgtcgaacaagtagccgaactcaaaacacaattggtggaacagctgggcaccgtcgacttcgcgttcctcaacgccggagtcaacgtaccgggcgacgatcaagacgccaccgaagaagtatggacgcgcaccatcaacatcaacctcaacggcacctaccgtaccggccgcatcgcgcatgaaatcatgcgcgaacacggtcatggcggctcactgatcttcacagcctccctgtccggacacaacgcgaactacatgatgggaagtccgacgccggtgaacgcgtatggcgccaccaaagcggccatcatggaacactcacgttaccttgctgccgcgctcgccaaggatggtatccgttccaacaccatctcccccggatacgtgtggtctggaattttcaatggccgtatcgacatgcctggccacgacgccatgctcgaggtcgtgccgatgcatcgtttcggcacgaatgacgagattgccagcacggtgctcttcctcgccagcgacgcgtcctcgtacgttactggcactgacattcgcgtagacggcggctacagcgtcttctaatcaccgtaccccatctgataaatggccggtcgcagctaatgtgcttcgaccggccatttatctggtgatggtttctagaacataccgctacacatgcttgcggcgtatcaacgtatcggcagtggttccggctcctgcaaggagaagcatgaccgcgataatgggaacgatgtcggagcccgtgcgaggcaagtccgcagtcggttttccatcggccttgctggcattcttgtctttcgagggctgcttgtcattcggcttggcctcgccaccgcccggctggtcatcaggcttcgtttcccgaagcttcagaccgtccaatgccgtgttaaggagcgtggcggcattggagacaagaccgttctgttcgctgctgaacgtggtgttgttccacagcgagagggcctgctcgtacgcttccgtgagagatgcgaccgtatcgtccgtgtatttgccgaattcggcaagcttggcctgtgccgccgcgatcggagcttcgagcgcgctcttgtcgagttcggtcggatcatcatacatggcctgatatcctgggatggtcagtttggcgagctgatcgtacatcttggagcagaggcgagcgttgaagttcatgacactgaaccctgcgcgggacaagttcatctgtcggattttcagattgtctggatcgtaggcgccttcggcgaacgtcatgtcggccgattcgctgtcggacgcgcccttgcctgttccgctggtgtcgagcgcgctgcccgtggagtagtcgaacggggtgccatccttgccgctccatgcgttgatgatgaggctcgacgtgcggaacgggtcagatccaactcctgcgtagttgtagaccgcaatgtccttgccggaggaaacggtgtcgccgttctcatcgacgaagtagatcgggttgccgtcgacgtcgagcggatacccgtcgggaccccacacgttgtcggtgatcactgcgagaccgtcacggtcggtatagctgcccatgcgggattcgcgatgccatgcgttgccggtcgtggccgtcggatgcggaaacagttcggctccggacgcggcataataacgaccgagttccggatagaagtggccgtctcaacaaatgtcgataccggccttgagtggcttgccgtccgagccggtccactcgggcatctcgaacatgaccggcgtgctgccaggcaacgaccatgcggtttcctcggatccggcgcgatgcatcttctggtaggagtcggtgtgcccgtcagggaacgctatggcggcagaattgtagaccttccgcacgccgtcgctgtcggtgatgagactctcggtgatttcagcttgggaggccgccatcttgtatgctgcggagtctaggtcgcttgaggaaacgtagccggtgagtgccgcgacgaaggccatggtggcgcacaatgcgacgctgcctaccgccgcaaccgccatgttgagctgtcgtttgaaccatatggatttcgcggtgacgttcgctgccgcgtctttgttctccgttgtcgtacggtgcgacgtggatgtccctctcttcaacgcgccatgcttccccgaaatttccccgttctggaaaacgtcataggagataaacggaattgtatgacagttcgttttccacttggcttctgaattccgaagagtagctaaagagtactcatgcccgattctgcgagcgcgatcatttgacgtttcctttgttgttgaacaccgttttgttcatatctcgcttatgtatggcagatttgcgaacttgtccggagatatcttgcttatatatggcaggtcagtccgtcaaagcagtaggtagggggtatgaaaaacctcattttcgcgaagccgactgccatatataagcgagatgcctcatgtcacatcccgaaatctgccatacataggcgagatacagcctgctttgctcagcacaaggccgacagatccagaaaatgcgcacgatgacacgtttcaaaccatacttcgcgcaggatctttttccgatttgttcccttgacaggtctgacgcctactgcttgggcagttcgcggcggcgcgcaacgagtcaacgaactgtgcacacgcaaaggcgggtatgatgacgtttattctcgcttggtatcggcacttgaaatccgaagaacagtaaggagataatcatgtccgacatcaatccgtcagtagcctcggcagcacagaaccctcctgcatccgcacgactcgaagcgggactaacggccccggactttacacttcccagcgacaacggcggtagtgtcacgctctccgcattgcgcggccaaaatatcatcctatacttctaccctgccgcgatgactcccggctgcaccaccgaggcctgcgacttccgcgacaacctcgcacgcctaagctcccgcggattcacagtgctcggcgtttcgaaggatccgctggacaagctcatccgattccgcgagcgcgaccatttgacgttccccctgttgtcggatgctgatttgaccgtgcatcgtttgtatggtgcgtacggtgagaagaaattgtatggcaaggtttacgagggtgtgattcgttcgacttttgtgattgatggtgatggggtgattcgtgttgcccgatacaacgtgcgtgcgaagggtcatgttgattctttgctgcgtgcgcttgataagcttgatggttcagttttctagtctggaatgcgatgccgctttgtttataaatcagctttttcgtgcgaatgacgcaagcagcgtcagtagcgggtagatgccgaattcctgatagcggtcgtgcagtgtgccgatgtcttcgaacatggctcttcggcgagcctttcgaaggtctcgtaacggcacggggcacggcctcgtatgagaagagaaaaagcgcgatgagactcagacttccaacaataaatcatcgtcttccgacatgtcagcccacggctcgcatgtgcggtttgcttgatcgtgttggcggtgcgttggttgatgagcgtgaacgtttggagttgaaggcgattgaaatgctgaaggagccgaaacgtcttgtgcagccggagccagtggatcatgcttggtgggatgatggttccggcgtgtacagcatcggctgagggagccggtaggctgggtgtgtaaatccagcagagaggaacgtgccatggtgacgcgtcgtaatgatgagcggacggttgcgggaaggcatcgcatgatgaggcgtgccgaccgtgaggtaaccgaaccacagcagatcgatgcgattatcgcaacgtgcaagatcgtgagtcttgcatacaccgatgcggaaggcatcaccatcgtgccgttgaatttcggatacgtgttcgatgcggaatccaatcatctcaccttgtatttccatggttctgcgaccggacgtaagatggacgcggtcaaggccgcaaacaacgcgcttcccatggcgttcgagatggcgactgactgcgaggtggttgaggggcgcacgttgtgcaattggggcgaggcgttcaagtcgatcgtcggcaatggcaccgcatccatcatcgacgatcttgacgaggcacgccaggggctcgcactgctgatgaagcagcaggccggcatggaacatgcggaattcaccgaccagcaggtacgcgccgtcaccgtatggaaggtggaagcggactatctcaccgccaaagtacgcgaaaagccccagccgcatacgcactgacctcataccgcaccttggcgcaatgatgcgctgcttccaagcccgaggatgggaattgggaacagcgcatcagatgtaaaacgctagaccgaagtccggctgcggccaagttgcaagtcaggccgtaacccggtcgagataaggtttcaaatcaagccttccggcgggaacgccgcgcgtagcttcctccaaaaatcgcggaggacaccatcacgacggtcgccacgatggcgggcgtcacgtttgaaccggttttggcgagcttgaccgcatcgccgccgttcgcggacgatttcaccggatgcttccgctggccgttcgcatcattcgcacccggagccttctgcgaatcatctggtgtcgattcatggcccggcgtttcaggctgaccttcctcatccgtcagtcgggcatcaaccgtggttcccttaccattcaggcagcttttcagctcgctttccttataccaggtcgaaccatccgcaattggcgtgcaggaatcgttgaatccgatttccttctcgttgtacagcattctgaccaacggctgatacggctgccccgagacgtccgtaccatcacgcacgaccacatcccactgcacattcgcagccatcggcgtcacactttcgccacgccacggattattctcatacgtgtacagttcactcgcctgctgctgcgatccaggcaacttcaacaatgccgcaaacggaataatggtttcggcatgtgcgaatcggaacgtcgcggcggtgccggcccgctccctcgtgtcaatcgcattgaagaaatcgtcgagcaacggctgggcaatgcggtaggtctcatcctgacctgcgcgccccggtcccttctcatagaagtcctcggcatcaagcgaccaagcaaacgtcttcgcctcctgggcgtgctgaccttggaagtactggtcgaaattgaacgtgtgggatccggtgttctcctgttccatatcggccgcgatgatgtacagattgtacaaatccattgccgcatcctgttccgacgcgatcttcttcttggcgtcaccgcacgcgttcgcatccttggcagggtcggcgccagcagcgcaattggccgcaccctttttcgtgccgtcagccgtgttgtaccagatgcgctggccttcctccttgccgatggacgcgaggaaatcggcagtgaagatttgagagagcagattatgcgaagcggtggtcatggacggatcgttcgtcacgttttcctcagcttcggcgatgcccccatcattcgcgacgaactgctggtaacgttccgcgcgctccttggcctcgcccgttttctgcgtaccatccggattatcagtcttatggaaatacaacgtggtggtgttcttgtcgaaattcttgccggaattgttatccgcaggatcattcggtgctacaaccgcattcgccagcaaaccgttggaagcctgatcgaatcctagtttgaaattctctccggattcggttgcacgaggctcacccgagctctggtatgagacgcgcagtccctgctttgcggcattggcgaacagatcagcatcacgctggtatattctctcaccaatgccctgatgctgtatggcgccctgaccagagagcatgccatacccgttgcccacgttgaccgcagtaatggcattgacattgttgatgaattccttgccaacctctgggctaacgaatccagcataattgttttccgcagcagactgagccatcagtgccagcaaagcgtcatacttgtagctcgacaggccacgcgagccatgccttgccacagactcggtgtatgcaagatggtatctgctcggaattgctgaatatgatgtgctcgccggtgcaacatacggctgcttgctgctgtaataccgggcggttccttccccagccaaagccgctggcgttgcgagcatggccgctgccactacagcgcttgccaacgcgagcatgccaccgcccaccgatttggtaccgcgtttgcgccaggctcctgcctgccgctgttcctttgttgccgtatggtttttcgccattatcctcattcttctacctcttctgctttgccacattgaagctgtcagacaagccagcccgggcgacaaaataggctcggaaggcgaacacgcaacgccttaaacgtgaacgatcgacaaataatccgcgaaccgtcgcttagaactcaagtaagttgcacagccgcaactcccccaccccatggattcacgatgctcgacgtatcacagaacccgctggacaagttccaccgatttcgctgcggacacccccaatcaacgcacatcattatggctggccgattgtcgacttgacacgtggaaacgtccccgcctttcacgtcaggaccgaaaacccaaagtatgcaagaatccggacgttacaggatgcggacgttttcttggagactgaatgaaaggattatcgtatgttcggtcccgaggaacgacggcgcggaggggtccttcggacgcatgaagatggagtccgtccatcccgggcattgggaggaacgtacccgcgacgaggtgctcgtcccggtcgacgactgcatccgctggcacgaccacgagcgcatcaaacggtcgctcggttggatgagtccggtacaataccgtcagagccagggaatggctgcgtgatcatctccaagaaaacgtccgcagcccctctgccatttgcgatcagtcatggcacgctgattccaatgggtttcagcagtacgctggatgacgcattatcgcaaatcgtcgaacacgccatcaatatgattgccgccatgttcgagatgccacgtcaacaagtgtacctgctgctgtcggctgccatcgacttcaacgtgacgcaagtcgttgatatcacaccaaaggcgttcacggtctgattgatctgtcgatgtttcaacaactacccgactatgaacggacgatacgcgatattggaaacagcagatggactgccatgcggcgcatgccttattggcccagcaggctcagacaagtcactgattggtctagccaaagaactctataagggaatggaataacagatggtttccccaacaaacaatcatgcagcaagatagcaacaccacccaggcgacggatcgcgccgaaacggacgctctctccttcggcgcgaagaaaatcgcaatcatgattggcgtgggactcatcgccggttccctacactgcctatgttgatgaccatgccgttggcgtagctgatctacctgtgtttccgccgtatcatccatccgactcgcgcataaccgtccatacgggaatcctcgaacgcaagtaaatgtcgcttccgtcaatcgtcgaccgcaagaggcgttcatggagcggcggatttccttatattccaacaaaacccgtactgttatgcgacacgtaataacagtacgggttttctgtgttactgttatatataacagctaaacagtttgcatctaactgttcagccgggagatatatcacctacgaaacatacagaaaaagaggcacagattgaagctgatcatctcatccgtgtccggagaaccgatttacgaacagatcaagaaccagatcaggtccgcgatcatgtcgggtgagcttacagcaggcgaggcgcttccctcactgcgcaagctcgccaaggaactgcgcgtcagcgtgctcaccgtgaccagagcgtataacgaactggccgacgaggggctcgtggagaatgtgcagggcaaaggcacattcgtgatggaacgaggcaacgaactcatgaaggaacgtgcgcgtgaacgcatcatggacaagctccgtgaagtttccatcgaggccaaagccgccgacatcagcctacttgatctgcttggcatgttcgagaaagcgtacagggaacaatcatgaacgattcctcactcccccaaggaacgcggccaaccttggccttgagcgtaaccggattgacgaagcattatgattccggcttcacattggatgacgtgaccttcgacctgccgtccggctacatcatgggtctggtcggtccgaacggagccggcaaatccacgttgatcaaactgatcctcaatatgaccgcgcgagacgcgggacgaatcgaagtgctcggccttgacgcgatggccgatgaggagcgggccaaagagcagctgggcgtagtgctcgacagcagctatttcatcgaatacatgacggtcgacgcggtggaacggacaagcagcccaatgtacccgctgtgggaccacaatctgttcgacgcatatctcagacggttcggactcggacggaacaagaagatcaaggatctgtcgcgcggcatgcagatgaagctcatgctcgccgtggcgttgagccacgatgcgaaactgctgattctcgacgagccgaccagcggcctggacgtactgtcccgcgacgagctcatggacatcctgtccgattatgttgcggatggcggacacagcgtaatcttctccacgcatatcaccgccgatttggagcgttgcgcggatttcctcgcgtatataacgaacggcatgctgtattacagcgggccgaaagacgagttcgaagacgcgttccgcctggtcaagggcggtccggatgagcttacggatggtctacagcgggcaatggtcggcatccgcacatacgcaaccggcttcgacgcgttggtccgcacgcaggacatcccacacatcggcggcaccgacggtctcctgacacagcatgcttcgattgaggatgtgatcagactgaccaacgccgcggcacatacggcaatcggcaataccaacaaaggagacgtacgatgaacacgacagcgaacgcggacgccatgaccgccatccttaggcagatttccttggactggaaccgcaccatcagctacgggcggtcgtacatagccatcttcttcgcgtacgttccaggcttcacatgcctgatggcggccacagggtccactctcgacagcgttgcgggagccgccatcggcggggcggcctccggcttcctgatgcttaatatcaccctgttctcctatgaacaaatgaacaaccatcattggatgaacggcatcgtgcccatcaaccgcaaccaccagatcctcggacgattcgcattccttatcgcctgcgatctggtggcgggattggaagtggccgtcagcatcgcctgcgccggcaccatcatgcacgagccagttaaagtgacggatgcgatcgacttcgccgcgatgaccgtgctgaccctcgtgctgctcaacgccatcgtgcagccgttcctgtaccggttctccccttatcgcgccatggccgccattattctgagcatcggcgtgatcgtgggcacggtcatcggactgcgcaaggcattgccggaattcgaaaagaccgtcgaacagctggccgaagcgatcagccggcaccaagccattgcattagcgacattcttgatcatcgacgtactcgccttggtgttctccagcaagatatcgctgcatatttacggtagcaaggacatctgaaccgagccagccggtaaactcttatggaacggatttggggtcttccgaatcaacggaaagccccaaatgcatatatccccgcacgacgccggttcctacaatacggcaggcgcgtcgtggaagtcgaacatgacaccatccgccagaccgcaaatcgccggccaatcggcatcggacgaatcgtcgtgcatggcccataccttcatgccaaccgacttggcggaacgcatgccgatcagcaaatcttcgaacacggtgcactcccccggctcgactccgaggcgagatgcagccaacagatacacgtccggctggtctttgccgacgtcgccggcatcatcgacactgaccacttcatcgaagtagccgaaaatgccaacatgcttcatcgccggctctctcagcatcggcggcagcgatgtggcaacggcaagtttcgctccactctctttcaattgagcgagatattcacgtgcatacggtttggcttcgaccactgtggcatacatgacgcgggccatatgatcccactcatccatcagctcttcgggagtgtcggtaaggctgaaacgcgcaatcgtatattcggcgatctggcggaattgcatggccgcgactttcgtcatgtaatcgtccggcacgtcaatgcctcgttttgaaagaaaatcgatgtcaacctgatcccaaacgcccatggaatcaagcagcgtgccgtcaagatcgaaaatggcgcccttgccttgattgcccgccatcgatatcctcctttattattgtgcatcttacgttaatcgagaaccgatgatttgagcagttcttcggcatgttccagcgacgcttcgctttcactgccggagagcatacgggcgatttcgtgcacacgcgcctccccacgcacttgattgatggtggtggcgattgatccgtcatccatttcacctttggcgaccacgtactgttcgtccgcccaggatgcgacctgtggcagatgggtgacgacaatgacctgcgcggattgagcgagtttcgccaatcgcgcgccaagctccaccgcggttttgccaccgacgcctgcgtcgacctcgtcgaaaatgaacgtcatgggaggtacggaaccgcccgccaccacatgtttttccgccgcaacgagttcaagcgcgagcatgagccggctcagctcgccgccggacgcgcttttgcccatcggcatttgcggcgaacccgggaacggcgtgaacagaaaatcgatgccgtcagcgccggaagcgtccaaatgttcacgttccgatacacggatctctagtttcgatccgctcatggcaagagattcgagttccgcagtgactttggcggcgagttccttcgcggcagcgacacgccttttgcttaccgcacgcgccgccttcaacgcctcaccgaacagtttttcacgttccgcctgcaattgactaactttttccggagacgcgtccagatcctccaaatcgaacaccgcttgatctcgccacgcaatcacgtccgacaattccggaccccaacgacgaaccaattcgtcaagctcatggatccgcccgttgatggcgtccaagtcttccatgccgagatcattgtcgacttcgcccgacaaggtgaacaccacatcagacaaatcagtgctgatggaatcaagccgatcggccagttccgaaaacacgccgtccacatgaatggcgcgaagcgcttgcgacgcgcgatcaatcagatcggtggcgctggatgattcaacatcgtcaacaacctgcgaagcatccaacgcgctcaacgcacggttcaccccttcggcgatttcggccgcgttctcaatgcgatcgcgccgggcacgcaactcggccatctcccccggctgcggatcgatgcggttgattcgttcgatggactcgcgcaggtaatccgcctgctggcgcatggacgattcctgactcgacagtcgttccaaccgctcatccatggcacgaagcgcattccaagctttgccgtatgcgaccaacgctacatcatcgccggcatagcggtccaaaaactcacgttgccgcgtcgaagacgcgatacgcaactggtcggcctgaccatgaatcgtcaccagctccgctgcgatcgaccccagtacggaacgaggcacgctacgaccagacagcatgctgcgggagcgcccggaggcaggaaccttgcgcgacaggaacagttctccgtcttcaggttcgaaacccgcctcgtgcgcggctgcgaccgcggccggtgacgaggcgacctcgaacacgccctgcgcccacgcctcgttcgctccgaccgacacgcggccaccgtcggaaggaccgccggaaatcagccgaatcgcactgagcagcatcgactttccggcacccgtctcaccggtgatcgccgtcataccgccggcaggcgcgatcagcgcggaacggatcggcccaagattatgaatctcaagttcttcaagcatcagtgtttttactcgttcgtttctttatcttccggaaacacatgcccatgatgcactcccccggttttacgcgcctgctcgcgccaaccgacaacaggaagatcgaatttcgtgaccagacgattcgtgaacggcacgccggaaagacgggccaggcgcaatgtgctcttcgattcgcgcacctcaaccctagtgccccgcggcaacgcgcattggcgacggccatcgcagcagatccaaccatccgacgtggaatcctcaaggatatcaatggcgaatgtggaaccggagccaataatcaatgggcgagcgaacagggcgtgggcggccaacggcaccaactgcaacgccttcacgttcggccacatgatcggtcctccggcggagaacgcgtatgcggttgagccggtcggagtcgacacgatcacgccatcgcagccgaaggagctcatttccacatcatccacacgaatcgacagttcgaccattttgccacggtctgcacgctccaacgtgatgtcattcaacgcccaatcctcaatcggctcgcttgctcccggcagccacacatcgacatgcgcaatcatgcgttcgtcaatggaataatcatgctcggcaaccctgcggatcgcctcactcatctggaagctttcaaactccgccaaaaagccgacatgtcccaagttcacgccaagaatcggcacactggtgcagtgcaccagttcagccgctcgaagaatggtgccatccccgccgagcaccaccacgatctcagtacgttcggaaaccaccggcggctgcttgccgaaatccggcgcctcgatattgtcaatgatcgacacttcgaaaccggcctgggtcagctgcccgacagcctcctcaaccaccgtgccactctccctcagacgactatgcgtcaccaccaccgcatgacgggtaccgaacatcgttaatccctttccagcaaaaggaaacgccctatggaaaacgcccatgaagacgtcaccgacctccagtgtaatcgaacaaatgaacgaaaaccggcaatgcgcgtcgaaaacatgccaaaacccgcgaacacgcctcaaatccgtctccgatgcaagccacgaatcaggaatgtcagccgtcaaatagcctgttagtcgcacatatgcttacaatagctcacaggaacgaagaccgaacatcgtaagaaaaggagagaggaacggcatgtcaaacctcgtctttgacgagtcctcctccaatcgtgaggcctcacatggctacgcatggtggttctcgggagatactttcgagaaggccatggcggaagaccgcaagccacgcaagcgcggcctcacgcgccgactcgtcaaccatccaggccgtctgaccatcttctactttctgacgctcgcggcgttgtccactacgttgctgatgacgcccattgccacgccgaaagacgaaaccactacgttcaccaccgcgttcttcaccgcagtatccgccatttccacatgcggcatctccatcgtcaactccaccacgcattggaccaccttcggccaaggcgtgctcatcttcgccgtgcagatgggtggccttggcgtcatgacattcgcctccttgatcgcattggccgtgaaccaccatctcaaggccacgcagcgcatgctgaccgccaacgaactcggcactaccaagctcggtgaaatcaaaggcgtgctcaccgtagtcatcaccaccgcattcgtcatcgaaggcatcacattcgtcgcattgttccccggcctctacaaggtcaaccacggtaatgtgcgccacacattgtgggaatcgctgttcttcgcggtcatggcgtacaacaacgccggcttcacccccgacggcgccggtctgcatgtcaacaactgggcggtcggcctgccgatcctagccagcgctttctgcggaacccttggcttcccggtattgctgaacctgatgcgttcctggcgtatgcgtcgtcctccgaagcgttggagcctgcacaccaagctcacactgaccaccacgttctgcattgtgatcgcctcgttcacgtggttcctgctgatggaatggaacaacaagctgctgttcgccggaaacggcatcgagccgcgcctctggcacgccatggtcgcggccgtcatgccacgaagctccggatttgacctgtcgtggatgccaggcgtcagcgacgcaaccaaagtgttcctgtccatcgtcatgttcatcggcggtggcagcacctcgaccgcaggcggcatccgcgtcaccacgttcgcggtgaccctgctgacctgtcgtgccgcattcaccggacgccacgacatcaacgcattccaccgccgcatccacacgcaggcggttatgaccgccgtggccgtaagcacggcatgtctcatgctggtcaccgtggtgtcgatggcgctgatgatcatcaccggctgctcgctgtgcgacgcactgttcgatacctgctccgcgttcggactgggtggctactcggtgggcgtagccagtgaaagcagccccacggtgctatacattctcgccgcaaccatgttcatcgggcgtctcggaccgctcaccatcgcctacgcgatttcgcgtccacacaatctcgaggccgtccgctaccccaccgagcagatcgtggtcggctgacgatacggcttcatatacttgcagttgcctacaatcacacatgaatatagatttttgaagatggaatttcgaaaggtgcataacatcatggccaacaacaccagaagcgttctcgtagttggtttggggcgttttggcagctctgtggccaccacgctcgacatgatgggccaggatgtgctcgccgtcgacaaagacggcgaactggtgaaccgttggtcttcgcagattcccaccgtgcaggccgacatgaccgatgtgatggcgttggagcagatcaacgcatccgatttcgacacggccgtcgtggctatcggcgacagcgtcgaagcttccgtcattaccgccggcaatctgctcgacgccggcatctccgacatttgggccaaatccgtgtcgaaggaacacgcccgcattctgcaacgcatcggcgcacgccacatcatcaacgcggaaaccgacgccggcaaacgcgtcggacatcttgtgtccggcaactatcttgactacatcgagcttgaaggcgcgtacaacgtcgtcaaaatccatacccccgcgcatgtggtcggctacaccatcgaagacgctcgcgtgcatgaacgcttcggcattaccgtggtcggcatcaaatcgccgggcaaggaattcgaatacggttcgaaagagctcatcatgcaccgcaacgacgaactcatcatcatgggcaagcagaatcaaatcgaccggttcctacgcagctgacacgctctttccatatggaaaaatccggaatttcataatcatgatttccggtttttcttttacttatcttatttgccttgattacactgcagacacggttctctcaaccggtcgctgtttcactgcatgaccgcgtacagcagatattcgatattgccatgcgtgccttcaatgggagatactgttgtggcgcgcacgtcaagcccgttgcgttccgcgcatgccacgacggaggacagcgcctgttcgcgtaattcctggctttcgacaatcccgtttttcccaaggttgcctttgccgacctcgaactgcggtttgaccagcagcacgatctgcgcctgcggtgcggcgattcttgcgatcaccggaatcacatatgtcagcgaaataaacgatacgtcggaaacaatcatttccggacgatacggcaaatcctccgcatacacgtcgcgaatattgacgccgctcatttcgataatacggtcgtcatgcgcgattttcggatccaattgcccatggccgacatccaaagcgatgacctgcgcggcatcattgcgcaatagcacgtcgcagaaaccgccggtggacgcgccgatatccaagcaacgtaatccttgcgcggaacgcaatccgacgtcggcgaaccgttcgaacgcgccgacaagcttgtatgcgccacgggaaacgtagccgtctcccctatcggcggcgatgacgtcatcaccaccgactttcgccgatgctttggtgacggtgacaccgttcacactgactttgccatccgcgatcagacgttgcgccttggaacgactgtcggtcagaccacgttccaacaacgcaacgtcaagacgaacaacctgagtggaatcactgtttcgcaatggttttccaataatcggtacgaattgttcgttaggaaatacggaattccggaacgatcacgccactcacatctcgcccgctgtcggccgcggcccacatggcgcagcatgcggcacgcaacccgtcgacactggtgatgtcggtgacatacaggcggtcgccgtcaacgcgggccttcgcatcgcggcacagccatgcgccctcatcatgcaccacttcaggagcgggctcgttcaagccccgcagatctttggcgatgtaggtcgggcgaagatacgccggagcgaacatgagttcgcgcggatcggtgacgccggtcaacaccgcaagggaatcgtacccgccccgattgcccgcctcgatatcggtgtcgagacggtcgccgatggcgaggcactgttccttgtccaccggctcgccatcatcatgggctgcgagaatgcgcgcctcgtcatacatggcggattccggcttgcctgcggacgaaaccggttccacaccggtggcattgatcaccgccatgatcatggaaccgcatcccggcgcgatgccaagctcacgaggaatggtcagatcacgattggtcacgaaataggccgcgccatgctcaacggcataggcgatttgggccatttcgttccaagacatgtcgggataccatccttggatggcggcgaccggctgcgcttctgcggaatcgacgacttcaagaccttgcttggccacttcctcacgcagatgctgggcgccaagcacgaaaaccttcgaaccttcaggcacggcacgtgccaccatgcgcgcggcgacaaccgacgaggtgatgacctgccaggattcgacatccaaatcgaaccccttcagctggtctgccaccacggcctgaagtcgggacgaattgttggtggtgtattccaccgtcatgcccaaggattcggccttgcggatattcttggcagcatgttccaccgggttcttaccacggtagaccacgccgtcaagatcaagcagtgccagcgagtatgcttcgctgagcggctgattcgtggacttcagcatgcgggccacgtcacctcacttgttatcttcggaggattcggaagaagcatccgaagactcttcggcctcttcagcctcaccgtcatcatcggcgtcatcttccgcagcatcgtcagcttctgccggctcgtcatcggattccgcgcctgcttccgtctcttcggcctcaagctgggtttcgtcgttggtttcgccgttctcgtcgatggcttcggattcgtcttcctcattctcagggtcttccggagcgtactgcgcgtcatcttcggaaatgccaagcacgtccatgagttcgtcgttcagctcctgcatgtcgtattcgacaaccagatcgtcggaagtctcatcatcctcaacatcggcgtactgcagttcgagcttgtcgagcagacgatccaatgcgatggcctcatcggtacggccggcctcttcaaggaaatactgttcggcctgcaccgcacgcatgcggtattcgccggccaatcccttggaacggcccagcgtgtgcacgatctcgatggccttgtcccacatcttcagatcgcccagagcgccagcgtacaccaagaacatttcagccttggcttcaccgcgcagatacttggcgtcgtcgctcacagccacttcgatggccttcttcggctcgcccacgccacgctcgcagtcggcgatgaacggcagataatccaggaaaccgttcatacggaacgcggtgcggaactcacgcaaggcaagcttgtaatcaccctgacggtatgccacgaaggcgagtgtctcgcgggcgaaatcgatgcgggaagcctggcggaccacccacttggcatgttcgagggccagctccgggttgctctcctcaagcgtgtacgcggcaagaatgtgcagaccaatgttttccgcatgttccttcgacaggccacgcaggcgttcgcgatcgtcggtggtgagcatacgccattcgatgcccttcggcatcttcggctcatcaggacgacgatgcgtgtacgggttctgcgaggggaagctcaccgtgccatcggaattgcggcgcggcttggccatgtactcgccacgcttctcctcacggtaggccatcttctcttcgcgggtgaactcgcgacgctcctcgcgctgctgctggtcgcgatccttgtggaagtcacggcgctgatcgtcacgacggaactccttacgctcgccatcacggaaattacggcgtccgccatcacgacgatcattgccacggtggtcgtcacgacggaagttacgacgatcaccatcacgatggaaatcacggcgatcattatcgcggtggaagttacgacggtcgccatcttcacgacggaagttacgacggtcgccgtcacggtggaagtctttacggtttccgtcacgtcgatcgtcacgacggaaaccggaacgctcgccatcgcgctggtagcgaggattgtctccacgaccgccacgataatcgcgatgatcgtcacgacgctcgccgtcacggttgaacttgcgcggaccgttatggaagcggcgctcctggccttccccctcaccgtcacgacggaaatcgcggtcgcggcggaaattgccgccattgcccttgcggtaaccgcccttatgatcgtcgttgtggaagccgccggacttgtgtccgtaggacttgccgccattgccacgcggcttgaatcctttgccgccgcgatcgcccggcttgcccgagccgtaggacttgtggttgccgtaggacttgccgcgcgatccgcgctgttcttctgccatgctgttccttatattccttgtattccttgaaaatggtcttcgtttgttctttgtttacgtttatttgcgccgctcgtgattgcctcacacgttttcgacgacgccgagggccttcttgccgcgacgaatcaatgcgaaacggccatgcaggaagtcattttcgttcaaaacctgctcttcgtcttcgacacgggcgttgttcagatacacgccgccagccttaatcgtcttgcgcgcttcggaaatcgacttgaacagtccggccttcatgccggcttccgccacacggtcgcccaccgcggccttggcgaactcgccgtcgatcttcacgccgtcaagagcagcttcgagcgtggactcgtcaacgcccgcaagatcgccgccacggccgaacagcgcaccggcggcctcgatggcctgtcgggtggcttcctcaccatgaaccaggctggtaacctcccaagccaaggtgcgttgcgcctcacgcgcgcccggattggtcttgctttcctccacaagacgttcgatctccgccttcggcaagaacgtgaacaccttcagcaggttctccatctcgctgtcagggcggttgaaccagaactggtagaacttgtacgggctcagcatagtgccgtcaagccagacggcgttgccttcggacttgccgaacttcttaccctgagcgtcggtgataatcgggctggtgaacacgttcacatccacgccacgtaccttgtggatcaggtcaagaccggacgtgaggttgccccactggtcggatccgccaagctcaagcacgcaatggtattcgtcgaacaggtgcaggaagtcgttgccctgcagcacctggtagctgaactcagtgaaggaaatgccatcttcagaattcagtcgacgggcaacggtgtctttggcgagcatggtacccaaacggaagttcttgccgacgtcacgcaggaagtcgatgacgttcatagaggccgtccaatcgtaattggacacgaaacgaaccgggttgctgccttccacttcgagaatgccgccgatctgcgccttcagacgctcggcccaaccagccacgacgtctttcggattgagcgtacgttcgcccgattggcgaggatcgccgatcaagccggtggcgccgccgaccagggcaatcggatgatggcctgctgcctgaaggtgacgcatgttgatgagctgcaccagattgccgatatgcagagaggcagcagtcggatcgaaaccgcaataataggaaatgggatctccgttcaacgcttcggcgagtcgatccctgtcagtggactgggaaatcaacccgcgccattccagttcatcgaggacggactcgaaaccggcctccttgaaatcgatgacgtgagccatagctgtgttttctccctattgaattgcggatgatactgcgttttacgcaccctacagtttcgcagaagatgaagacaggcacacgcggtgtttccccatcatccaccaaccatcgtgcatacaggtaaagttagaaggagcatccccatatcaagaagggagatacctgcatggaccgcaaaggcatgaaggttgcggctaagaaagcccagagacaacattattggatgacagtcgccatttgcctgttcgcttcggtgttcggtgttgcgtacacttcatcgacgctctcggtcagcaccaacatttcgatcagcaccccgcaaacggaggattccacgcaatccaacgacatgtatgacgtattgcaggatcttgccgtaggcaatgaaaacgatgcccgtgaaaaggtcaagcaaaaccaagagcagatcgtcaacaacgataccgatgccacgttcggccgtcgccgaggagtaatcgcgtccctgctcaactcgtttgcatccggctcgatggtgatcgccgtggccgacgccattaattccgtcacccataacggcggcgtctccatcgccgtgccggtaatactctcgctggccgtctacattttcgtctggctgttcattcaagaaacataccgcatcgtcatggcacgtatgctgttggaaggacgttcctataacaagcttccggcaagtcgcttcttctaccccattcacacgcgcaaatggccgcgcatggcatggaccatgtttgtggaaaacgtgttcctgttcctttggagtctcaccatcgtcggcttcttcatcaagcaatattcctaccgtatggtgccgtacatcgttgcggagaatccgaatatcgaggctttggacgccattcgcttgtcccgacgcatgatgaaagggcataaatgggaatgcttcgtagcggactgctcgttcctcggctggtacctgctcaaccttatcaccttcggcttgagcggcatcttctattccaatggctacaatgccgcgttcttcgcggaatactatgtgtacgtgcgttcgatggccaagactaccggcattgcaggcagtgagatgctcaacgacgaatacctgtacttcaaggccgagccgcagacgctccataccacgtacgccgatgtcgcccaatccgtagcacagctggaacagaatcttgttccagcgcccaagccgcatggattcacaggatttctttctgagtggcttggcatccgcattctgcatgccagcgcagtgaaccgctatgaagagtatcgtgagaatcttcaccagatgcagatcggcgagaatattctgaatggctccatttatccggggcgtcttgcgcctgctccgatgccgttcaaattccgtgaatcacgtaccatcagcgccgaccgcagctactcactggtcaatctgatcatgatgttcttcatcttttgcttcgtcggctgggtgtgggaggtaagtctcgcatttatttccgaagacatgttcgtgaaccgtggcacgctgcatggcccttggctgcccatctatggcaccggcggagtgatcattctggttctgctcaaaaagctgcgcgaaaagccagcgcttgaattcgtcgcggctatggtgctgtgcggctgcttggaatacttctcatcgtggtatctggagatgacgcatgatggtcaacgctggtgggattacaccggatactttctaaatatcaacggccgtatctgcgccgaaggattattgacgttcggccttggcggattggccatcgtatatctgctggctccggccctcgacaacctgctcagcagaatcgatgcgcgaaagcttggcatcgtggccgccgtgctgctcgtgctgtattgcgccgaccaagtgtattccgcgcaacatccgaatgtcggtgcgggcatcaccgactacaagggatcggacacgtcgctggaagcgcccactccatacgaaatccgtaaacgatccgatggactgtcatagcgtgattgtcatgcaaatcgcatatcgcaaacaataatgaaatcgcctgtcgttctttcgagcggcaggcgatttcatgctgttgcttattgcacgattatttgcgacgcagcatttcgtgcagagtttcgatgatcttgctgtatttgatggaatccgtgaaacgcagacgcgggaatgcgttaatcatacgacgctgctgcttgttcaggatagatgcggcagtggcctgcatattggcaagaatctcctgcgaggagtccgaccaatcctggaccttgtcttgcaccttgtcgcggaatttgtctcggaaaatgtctttgccccattgcagggaatcaccggctttctccgcatatgcctgcacggtttcgctgaacttcgcaagattgtcggccaaatcgatgatgccaagcactgtaataatggtatccgcgacgataaacgccatgaaaatcacgcacatccagtgcactactggcaaaggaatcatctgtgtaatgcgattcacttcaggctgtatcacatcggtgatgagcacacccagcagaccgaacacaatcgctccaagcaaacaaatgcgcccttgaatgttgaatcggcgatgactgtaatcccaccatcgtgcgtggaatagcttttccatgccccatgacgtgacatattcaagcatgcatgcaccgattgaagaaatgagaaaaaccgcgaaaggattatgcagatcatgcagcagcacaatcgcaagaacggctccgcaaccgtagatcgggcagatgggaccattcaggaagccacgattcaccaagcgacgttccgaaacggacacgagaatcgattcatatacccatccggcaaatgaatagaacaggaaccataagaacaggtattccagcatgagcatgctttcgcgccgtcactttccacttgtatgcatattgactttcggcttgtagaagcgctcaagactgaccgtttcccgtgtggcgctgatcttatccgcgacagtcaccaaatacccttcaagataccgaggcggtatcggcgtcaaaggaaacatatgattctcgatgctgtcacgttccactctattgagatggaaatcgcgcacggcattgcgcatggcggtgccaccatgggtgaaaccatgcatacgatgacggccgccatcatgagcatgccagtcgtaaagaaaataatcgtgcagcaaagcggcgcgaatcaacgaatgcaaatccaccctatgccataagcgcagcctgtcagcgatccatacggccagacaggccacacggatggaatgagcaaacgtggtgaccacgccatgctggtaacagactctttcgatctgcatatgctcatggcacagtatctcctggccgtgaagtcgaacaagctgctgtatctgcgttcgtgtcagtggcaccgctttgcctttgctatgtactgttgctgtaattatttgagcaatgattccggcgtcttgtatgccgggccgtcgctgacggagttggcgaaggcacgcagctgttcgatggcggttttcgcggaaacgatctgctcgcgcacgcgcagcggagacgtgcctcccttgccattgcgggcggaaacagaaccttcggtggatagcacttcgcgcacttcgggagccttgtcggccggaaggaattccttgaagacctcgatgaagtcatcgtcggccaggtcccacagttcctggccgcggtcttcggcgatcttcacgcatgcaccggaaagctcgtgcgcgtggcggaacggcacaccgttcttcaccagccattcggcgatgtcggtggcgagggcgaaaccggtcggcgcttccgcttcgaggcgttccttgttgaagaccatggtgccgaccatgccggtgaacgcgggaaggagcacttccagcgtgtcgacctggtcgaacacggcttccttgtcttcctgaagatcacgtgcataagcggtgggcaggcccttcagcgtggtgagaagaccagccagatcgccgatgagacggccggacttgcctcgtgcaagttccgcaatatccgggttcttcttctgcggcatgatggacgagccggtggaataggcgtcgtcaaggcgcacgaacgcgaactcctgggtgttccagatgatgatttcttcagacagtcggctgatgtcgacgcctgccatggctgcgatgaaagcgaattcggcgaccagatcacgactggcggtgccgtcgatggagttcgcggttaccttggagaagccgagttcgcgggccacggccaccggctccaagccgagggtgttgccggcgagggcgccggaaccatacgggcttgcatcgatgcgcttgtcccaatcggcaagacgttccacatcgcgcagcagcggccacacgtgggccatgagctggtgtgcgagcagcaccggctgggcgtgctgcatgtgggtacgccccggcatgacggtgcgtccggccttttcggcctgttcggtcagtgttgcggcaaggccgagcagcattttggcgatgacgcggctgtggcgacggagccacatgcggatcagcgcggcgatctggtcgttgcgggagcggccggcgcggagcttgcctccaagctcgtctccggcgatctgcagcagtccacgttccaatgcggtggcttcgtcctcatcgtcttcgatcggagcgaacgcaccggaatcgacacggcgctgcagctcgtcgagagcgtcttccattcgctgcagctcgtcggcggtcaatagtcccgcacgtccgagcgcacgggcgtgggcgcgtgagcctgcgatgtcgtcgtcggcaagacgccaatcgaattgggtggacttgctcagtcgcgcgagttccggagacgggccggacttgaaccggccgccccacagggcgaggtgttcaccattggttgtgctctcggtcattgttacttcattctccttgcagatatgactgagggagaggataccagtcaggatggtcctaacggtacgctctcccccattatcaagacgattcggcgtaaaaacccgcttactcgacgctgttttccggaacctcgatgccattgccgaacttgacgtcgcgggctgcggccacacggctcggcagaccgtagatgtcgatgaagccgttggacgacttctgatcgaagctgtcgccggaatcgtaggtggccagattgtagtcatacagcgaggtgtcggaacgacgaccggtcacgacggcgcggccgccatgcaggatcatgcggatttcgccggaaacgtacttctgggtgtcttcgatgaaggcgttcagggactgcgttgccggggagaaccactgcgcatcgtagacgagttcggcccagcgcttgtcgatatcgcgcttgatgcggtgctgctcgcgttcgaggcagcagttctcgagttcctggtgggcggtgatcagtgcgatagcaccaggagcctcgtacagctcacgggacttgatgccgaccagacggtcctcgatcagatcgatacggccgatgccctgtgcgcctgcgcgacggttcatctcttcgatggcctgcagcggggtgacgtcgtgaccgtcgatcttgacaggaatgccctgcttgaattcgatgacgacctcatcttcgactggcgggaatgccggatcgtcggtataggagtagcagtccttggtcgggccattccacggatcctcaaggaagccggtttcaatggcgcggccccacacgttctggtcgatggagaacgggctcttctcggtctgcacgatcggaagcttgtgctccttggcgaatgcgatctcgacgtcgcgggtcagcgacaggtcgcggatcgggctgatggccttcagtgtcggatcaatggaggagatggacacctcgaaacggacctggtcgttgcccttgccggtgcagccatgggagatggtgtcggcaccgaactggtgggcggcgcgcacgagatgcttggagatgagcgggcgggaaatggcggaaaccagcggatacacaccctcatacagggcgttggccttcagcgccttcatgcagtattcattggcgaattcgtcgcgggcgtctaccacatacgcttcaacggcaccgcaggcaagcgcgcgctgcttgatggtttcgaggctttcgccaccctggccgacgtcgagggacacggccacgacatccttgccggtgcgttccttcagatatgaaatggcgacggaggtatccagaccaccggagtacgccagaacgagacgattctgatcgctcatggtttccctttctaacatcaaacgttattcatcagtatatgcaatactctgtatatttatgcatatacggtgcgtcgtgtccactatacggctattcagcccttggacacgacgtccaacagccattgcgcacgctgtttcgcataatcgtcatcggcgcagatcaccatgacggtatcgtctccggcaatggtgccgagcacaccgtcgatgggctgcttgtcgatcacacttgccacatactgggccgcgccagacggcgtatggaccaccaccagattcctggccgcagcgaccgaagtgaccaatccggaaagcacacggttcatttgctgttccgtttttgcatcaggattggccaatgcggcttcttccggctgtttgcccagcgcataggccacggttccgtcagccaaacgggttttcgtggcatgaatctcgtcgagatcgcggctcagggtggcctgggtcacctcgatgccctggtccgcgagaatctgagacagctgcgactgcgaggtaacgatgcacgtcagcaacgcctgctcgatggcgctcaatcgagcggcccgtgtggcaggacgttgcagcgcaggcgtttggtccgtcatcaggccaacaggctttcatcgccgcgagccttgccggcaagccaagtcagcagcgccttctgcgcatgcaggcggttaccggcctcatcccaaaccacggactgtggcccgtcgatgacttcggaggtgacctccttgccacggtatgccggcaggcaatgctggaagatggcatcttccttggcataagacatgagttcggcgttcacctgatagtcccagaacggcttggaacggatggcgtattccgcttcttcgcccatggaaacccatgtgtcggtgaacacgcagtcggcaccggcgaccgcttccttcggatccgtggtcaccagtacagaaccgccgttttcggatgcgatggcttcggcatcggcaacgatctgcggatccggcagatagccgttcggtccggcaacgcgtacgttcataccggccacggcgccgccgagcaggtaggagttcgacatgttgttggccgcgtcgccgaggtaggcgatggtctggttcttcagattgtcgacgccgccacgatgctcggcaatggtctggaagtcggcaagaatctggcaagggtggaattcatccgtcagagcgttcaccaccggatgggtggaatacttcgccatttcctccacacgatcctggccaaaggtgcgccacaccacgccataggccatgcggtcaagcacacgtgcggtgtcggcaaccggttcgccacggcccagctgggagccggacttgtcgatgaccagcggatagccgcccagttcggcaacgccaatggagaagctggaacgggttcgggtactcggcttgtcaaagatcaccgcgatgccctgcgggccggcgaacggctgatggtagaaacgatcgttgtggaatctgatggcgagttcgagaacctgcttctgctcttcatggttgagatcgtcatcgcgcaacatgtggcgcaattcaggagttgccattgttggctcctttcaaaagagtttcagttcgttgtgattgccggctatgttcagtcgttgggaagatcagttggaatcttcgcgaggatggagatggcctgatcaatatcctgttcagtcaccaccagcggaggaacaagacgaagcgcatccggcgccaccgcgttgacgatcaaaccgtgctccaacgcccaattcatcgccgcatgcgcacatggatgggcaagttcgaccgcatcgagcaagccacgtccacgcacggagacgaaaagcggattgccgcaagccatgatgccgtcacgcaattgctggccacgcgcctcggcgttggccacgagaccgtcttcctcaatggtttccaacgtggccatcgcggcggccgctccgagcggattgcccgcaaaggtggagccgtgggagcctggggtgaacagcgcggaaagcttggctccgaaggagatcatgccacccatcgggaaaccgcctgcaacgcccttggcgaaggtcacaatatccggaaccactccgcccgcaagatcctcacgctggaatgcgaaccaggatccggtgcgtccgatgcctgtctggacctcatcgatgatgagcaacgcgttgttgtcgtcgcacatctgacgggccttcttcacatagccggccccaagcggacgcacgccagcctcaccttggatcagctccatgatgacggcggcgacaggacctttgccatatttgccgggaccggtttcggcaaacgcgtcatgcaatgcggcctcgtcaccagcttcgacgaattcgatattgggaaccagcggctcgaacgcttctcggatggagggcttccacgttgcggacagcgcgcccatggtacgcccatggaagccatgggtcatggcgatgatacgcgccggtttgcctccaatggcaggcgatgcgcccggcaaggtgcgtccatacagtttggcaagcttcaatgccgcctcgttgccttccgctccggagttgccgaaatacacatgagatccctcgggagcgcccgcaagctcaatgagcttcgacgccagtttgatctgcggctccgtggcgaagtagttgctcacatgggcggctttggcggcctgctcgctgacggccttcacccatttcgggtgggcgtagccgagtgcgttcaccgcgatgcccgcaaggaaatcgaggtattcattgccatcgacgtcccagatatgcgcaccttctccatggtccataacacgcagcggagtaccgaacacgttcatgtgcacccgggagtacttccccagccacttggcgtcctcactgccgaggttttccaactgttcagttgccatacgaactcctcatttcaataccgtcttcgggaacgaccatggttccaatgccgtctgtggtgaaaatctcattcaggatggaatgcggcttgcgtccgtcgataatatgggcgcgtggcacgcctccatcgatggccctgacgcaggcctccatcttgggacgcatgccgctctccaaatccggcagcatatcacgtaggttctccacgccgatgcgtccgatcaaagagtccttgtctggccaatcggcgtacaagccatccacatcagtcaacacgaccagcttgctggctccaagagcggccgcaagcgccgcagccgcggaatcggcgttcacattcaacacttcggtagcatcatcctcatttggagccaccgaggaaacaacaggaatgcgtccggcattgatcagatcctcaaccgcggatgcgtcgacgctcaccacgtcaccgaccaaaccaatatcggttggagagccattgatgatcggcttgcgctgcatggcggaaaagagcgcaccatcctcgccggaaagaccgactgcgaacgggccatgagcgttgatcaatccgacaagttcacgggaaaccttgcccgtcaaaaccatacgcaccacatccatggcctccggcgtggtgaccctcagacctcccttgaattccgacttaatgcccaaagccttaagcatgtgcgagatctgcgggcctccgccatgcaccacaaccggatgcaagccgacctgtcgcagaaacaccatatcttcagcgaaacaggctttgagatgatcgtcgatcatcgcattgccgccatatttgatgacgatgcgctgtccggcgaattcctcaagccatggcagtgcctcaatcagcacttccgccttttggtcggcgcgcaaatcggtatgcacgtcaaaatggaatccaggtcctttgagttccttggtcattaccgttcaatcagctttcgtaatctgcattaatgtgtacgtattcgtgggtcaaatcgtcggtccagacagttgcttccgcatttcccgcatgcaaatctatgtcgatgtgcacctcgcgcggagtcatgtcgacttcggatcggtcgcgtccggctccgccgttctcacagatacgcacgccattgacatcaaccgtgactttattggaatcgtatggcgcgacttccggtggcacggtgcccaacgagctgacgatacgtccccaattcgggtcattgccggaaatggcgcatttcagcaaattggatgccgctaccgcacgaccgcaggcaagcgccgcatcctccgtggtggcgccgatcaccttgacacggatgtcgtggctcgcgccttcgccatcgccgatgatctggcgtgccagagacgccgtagcctgcgcaacgagatcgttgaattcgtccggatcgggttcgatgcccgaagcgccggatgcgagcaggagcaccgtatcgttggtagacatgcatccatccacatcgatgcggttgaacgacatctccactccggcattcaatgccgcctgcaactggccggcgctcaccacggcatccgtagtgatgacgcacagcatggtggccaactgcggggcaatcatgcccgaccccttgaccatacctccgacatggaagccgttggagccttccaactcaacggttttcggcttggtgtcggtggtcatgatggcatgggacgcatccgcaccggcctgagcggtatcggcaagggccgcgaacgctttgtctgcgccagaaagcacatggtcaagaggcagaagctcaccgatcaggcccgtggagcagaccgcgatatcgctgtctttggcacctacaagcgccgcgaccttttgggccgtggccttggactgctcatatcccggctggccggtgcatgcgtttgcgcctccggaattaaggatgacggctttcacatgaccgtcggccacgatcttgcgcgtccactgcacgggagctgcgcagaaacggttcgaagtgaacactccggcagccatatccagcggaccgttattgaccacaagagccagatccttcttaccttcgactgcggaaataccggcttccacgccagccgcggaaaaaccttgcgcaaacgttacgctcatggcgccactccaatctttgtcaggcctgcatcttcaggaagtcccagtgctacgttcaacgactgcaccgcctgtccggccgtgccgcggttgagattgtcaattgccgcgaaggccagcaaacgccccgccttacggtcgatggccacctgaatatgggccgcgttcgatccgatgatattggcggtggccggcatgacgccttccggtaaaacaatcatgaaatcctgatccgcatatgcgtcagtccaaacctgcctgatttcagcatctgacatattcaatgctgtatcggttagtttggcggaaaccgaagcgagaatgccacgggccattggcacaagaatcggggtgaatcccagcgtgaactcgtttgccgcggatgcgttctttcctgcagcatgggcgaagttctgcaaaatctcaggaatatgacgatgagtaccgccgacagaatacggtaatgcggaaccgaatgcctcagctgcaagcaaattgacgcgcttcagattcttccctgcgccggagtagccgaccaccagatcggcaacaatatccgccggttcaacaagcccttgggcaatgcccggctgcagcgccaatgtggttgcggtcacattgcatcctggaccggcaatacgcttggttcctggaatcacctcacgctggtgctggtaagaaccatcttcggatatgccggtaatgagctcaggcatgccgtaagtccagtgctcatagaagtcgccgccgtagaactcatcccatgcggttttttcctcaagcctatggtcggctcccaaatccaccaccacggcattcggatcaagctgggaagccaatgcaccggatgccccatgaggcagcgcaaggatgatcacgtcatgcccgttcagtacttccggaatggtgtcttccaccacaaggtcggcaagttgcggaatatgcggcatatgcttgccaagcttgtccccaacggacgaacgcccggtcacgcacgtcacttcgaaatatggatgggccgcgaggatacggagagcctcgcctcccgcatatccggtcgcgccggccacggctactgtgtatttggccatagtcacgtctcttttcattgactcactgaaaacacattcagcatacactttatgcactatattgcataattatgcattcgtttcgtgtcgcatagtggtcattgcgtgactatgacgattatcagaagacaaggaaacacgccgaatcaggcggtaatcgactcgtctccttggcctgatcccgcaccgccaagcatgtactgcaaggtctcgttatacaggtcggcaacggatagtccatgcatcgccaaccaaatcacggccaaagtatacagcacgttgatgatcaccgcggcgagagccaagccataccctttcatgtggagcttcttggtacgccacatcgagattgcgccgaccaacgcgggaaggaccggcaccggcatcagcacggcaagcacgagagacatgatcgcataggcatcccaatggccgtatgcgggattctgccggggatcgttgagatccagattcggcagatagggcatattgccctgttgtggatattggttcggatcatacggatttgccccatacgggttggcaccgtatggattctgttgtccgttcgcattgtacggaggcatcggttgctgcccatttgaagggtattgccccgtttggtattgcatattctgctgctgtacagcatccgcaggttgcggttcaggttcaggcgcaccatacacgtatggatcgtagccggctggcagctggctgctcatcgcaccatattcgggttggttgatttgaccatactccggctgtgaagacgcagcggcatcggaagatgacgaaaccggagcagcatcagccgtctcctgacgttcgtcggtgttggtcggctgatactgttccggttcgttcataatcatcctctgttcttgggaaggtcgggatcaggcgcgcagctgcgcacccagcttggacgcttcatccacaatacgcttgcggatggcttcgctgtcttcggaagcgagagtcttatccggagcgcggaatgtgaccgcgtaggccaaagacttttcgtcctcgcccagctggtcgccggtgtacacgtcgaacagctcgatgctttcgaggctgcttccagcggcatcgacaataacctgcttgagctcggcggccgtgacatcggtagacaccgtaaaggccagatcctgcttgaccggcgggaaggtggaaatcggcttggcctgcaccggcttgccgctcaacgtggcgaacagcgcggtcaaatccaactcgaaggccgcggaatgggccgggaagcccaacacctcgttgacatgcgggtgaagctcgccgaccataccgacgaatacgtcaccagccatcacacgagccgcacgacccggatgccattgtgccggcacatcttcagccttcggctgatccagcgtgagagctgcaccaatacggtcggagatgcgctgcaccgcctcaacggcgtcagaccaatccactgcgcggcgctcgcccagccaaccggagtcaacggcgttgccggtcagaatgccagcaacatgcatcggctggtccggaagaccggcatcaagcgcggcaagctgctcgtccgtcggcttgactgcacccggcagcgccggaatcgccggagcgttcggatcccacagatacacgtggccgatctcatacagcgacacattctccacgccgcgacgtagattgcgctgaacggtctgtgccaacgttggaataatgtcacgacgcaggaacggacgatcaccggcgagcgggttggcgatctccacgctgacgttcttcgtctcagcgacgtccagcgcgaagttcttgtaatcctcatcgccgacgaacgggtagctcaacgtttccaccatgccgtattcggcaagttcatcggcaacctggcgcttgcgcagctgctcagcagtcagaccgacctgaccttcgaccggtgccggcggcacggtgacgggaatctcgtcatatccgacaagacgcgccacttcctcaaccagatcgcacggctcgttcaagtcggggcgccaacttggaggcgccacggaaaactcgccgttgccgcctcctgcgacggagcaaccgatgtcggtaagaatgtcgctgatggtgttcacgtccgtgtcaagtccggccacacgagccacttccgaagccttgaacaggatcggacggcggttagagacggtattgaagtcggtcgggtgctcgctcggctcgccattgccgtacctaaccatcagttcggcggccatttgggcggctgccggctgcagctggtcgtccacaccgcgttcgaaacgacgggaggcttcggacggaatcttgtgacggcgtgcggaacgcgcgatcgacacctgatcgaagtgcgcggattccagcaggatgttcttggtttcggcagtgacctcgccatacatgccgcccatcacgcctgcgatgccaagcacacgggagccgcgttcgccattcggggaatcggtgatcagcagatcctcgacgctcaaatcgtgatccttgccatccaacgtggtgagcttctcaccttcgttggcgcgacgcaccacgatcggtccttcgatcttatccagatcgtaggcatgcatcggctgtcccaagtcgagcatcacgtagttggtgacatccactgccaaggagatggaacgcatgcctgcgcgggtcaggcggcgacgcatccaattcggcgtatggctggccggatcgaagcccttgaccgcgcgagcgtaatagcgatcgcatccaaccacaccgtgaatcggattattgtcgtcgacgatcacttcgatgtcggtcttggtgccttccggcaggcccttggtgatcggcgccttctcgttcagggcgacagccggatcggtgtaggccgcaccggtggaatgatggtattcgcgagacacgccacggtatgagaacgcgtagccgcgatccggagtgatgttgatctccagcagcggctcgtccaagtgcagcaggtgcatggcgtcgtcgcccggctggagcttctcatactcttccggggtgaagccgtacttgcgaagcaggatgatgccgtcatggctatcacccaatccaagctcgcgttcggaagcgcacatgccgttggagatatggccgtaggtcttgcgcggttcgatcttgaaatcgcccggcagcacagcgccaggaagcgttacgacgaccttttcgccggcagccatgttcggcgcgccgcagatgatgccgcgcggcaccttgttgccgttctcatcggtctcgttgtattcgtcgccgacgtcaacgtggcaccagttgatgatcttgccgttcttctgcggttccggagtggcgtcgaccacgtagccgacgacgatcggaccgaccagctgggaggtgtggatctcttcctcttcgagaccgaccttcaccagatctttggcaagctgttcgtacgtaaggccttccggaacctcgacatggtccttgagccaatcaatgtcaaccattggcatgggtcaatcactcccccatcacaaactgttcgctgaatcgcacgtcgccttcgaccaggtcgtgcatgtcgttgatgtcgtggcgcagcagcagggtacgttccacgcccacgccgaaggcgaagccggtgtagacctcaggatcgaggccagcggacttcagcacattcgggttgaccataccgcagccgccccattcgagccagcctgcgccacccttcttgtcagggaaccacaggtcgagttcggcgctcggctcggtgaacgggaagtagctcggacgcagacgggtcttggcttccgggccgaacatggccacggcaagcttatcgagcacgcccttcaggtcggccatggtcagatgcttgtcgaccgcaagagcctccacctggtggaacaccggcgtatgggtggcgtcgagctcatcggtgcggaacacgcggcccgggcatgcgatgtacagcggcacgccacgggtgagcagaccacgcacctgatcggaggaggtctgggtgcgcagcaccatgttggatccgacgaatcctgcggcgtccttggcctgattgcccttgacgtagaaggtatcctgcatctggcgtgccggatgatcggggccgaagttcagcgcgtcaaagtcgtaccattcggtttccacttcaggaccgtcggaaatctgccagcccatggaaatgaagaagtcttcgacatcctccatcagtttcggcaacggatggcgcgcgccaagcggcttgcgattgaccggaagagtcatgtccacggtttcggcggcaagcgcacgggcctcttcctcggccttgacctgctgttccttggtgccatacgcacgaccaaagtcagcgcgcagcttgcccatgatcttgccggcgtctttcttctggtccttcggcagcgcgccgatggccttgctggcctgcgtcatcgcggattccgctccggcgtactgcgtcttgatggctttcaattcctccatgctggaggcgttttcgattttcgcgatgccctcggcaaccgcatcggttaccgcttgggcgtcgaataccgcaccttctgccacgagatacctttctcatttcccgtttgttttacgcgaaaaacgcgcaatttcaacgttttccgactttacattctttcaacatgactcgacatagccaagctcagcagcattaccgccgaactggtgccgaggttcaaggattccgctttgccatagagcggtatggacacgatcctatcggttcgttccaaaacttccttggtcaatccgcgtgcctcattgccgaacaacaccgctttggcgccggcaagcgtttccggcgcagcgattacatccgtcagggattccggctgccgggaatccgtgccatatacatcggccgcatacactgacaactcgtgagtatcgcaccatgcgaagaagtcgtccgttcccatggtcagaatcggaaggtggaacagtgatcccacggtggagcggatcactttcggattgaacacgtccacgcagtcgtcgaccaataccacggcggagcagccggccgcgtcggcggaacgaatcacggttccggcgttaccgggatcgcggacctgccaaaacgcggcgaccatcgcatgctcgtcgaaatcgtccggagcggcggacgaatcgaggaaagcctgcatgtccgcgacggcaagcacgccttgcgcgtcggcgctcatacggtgcatcaccgcatgagtgaccttgtgcacatacacgccggattgcatggccttgcccgccatctgcgcgacgacaggtgtcgcaaacgaggcatcgggctgtgccgactcgacctcaacgtagaggtcctcgacaagtcctggatgccatgtcagcagctcgcgcaccgattgcgggccttccaccatgaaacggccagaccgtttccgcccttttcgatcggcgagctcggacacgcggcggacgcgctccgacttggggttcgcaatgacttcggattttataggcatacgcgttagcctaacaccattgccgcaatgaataccccgtccatgtcgcgtttttaattcagaaaactttccagattcattccagcagcagtcgcagcagaccagccagagggcgcagtccggtcgcgatatgcagggtccgacaaatgattccagcgactctgccggctcgcaggattccaataccgataacaattctccggattcgcagcagtccggcaacgcacagagcgatgccccagcgctggcaaaaccactatgctgttactgatttccgggcttgcgaatcccacagagggaaaagtgttgtgcaacggcagcgatttgtcacagcaggatcgtcacccttcgccttgccccgtattcgacatgtcatgaatttggcaggtcgggtacggggcttttgcacatccatgaaagatatgcacagcttgcgagtgtgtctcaccgctttcgattggtttgcgaacatcggttcgttacactgattatctgacttattgtctgattacggttgggcgcgcgacatcatcccatgaatgttggaggtacaagcatgaacgtcacggtgtatttaggagctcacgaaggcaacaaccccgtatacaagcaggccgtggcggagctggccatatggattgccgagaacgggcaccgtttggtgtatggcggttccaacgaggggctgatggcagtcatcgccgacactgtgcttgagcagggtggcgaggtgaccggcatcgaggcgcagatgttcgtggacaagggtgtcgcgcacaagaatctgacccagctcaccatcgtgccgaatatcaccgaacggcgtactcgcatgatcgagcttggcgacgtgttcatcgccttccccggcggcacgggaacgttggaggagatcagtgaggttgtgtcgaaggtttgccttgaccagttgacgcagccttgcattttctacaatctcaacggtttctacgatgacatgaaggcgttgctgcagcgcatgatcgatgatggtttttccacacgggaacgtcagcatggtatctatttcgcttcggatcttgccgagatagagcatattatcgccatgcacaaggcataggcggctcagtaaggtcgtttttattcgacaggtttttcaagaaaacggggacgcccaaacgaccctcataatcggccggaatatcctccaaccggcccatcacaaccaacatgcatccacatgccccgcagcgcatccggtcaactccgggatgcttcgtttgccgaacttactgatcggatggaacccgtatccgtcggccacgcgaagaatggatttgcgttttattgtctgcatgatttacagtttcgttaccatgaacatcccgtttgtcctgctgtacattttcctcggcggcgtgctcctgttctccgcctattcgctctgggagaaagacaaaaacaatcggaggtaatgcagaatggacagcaaggcacttctttccttgaaccatttaagcgtctggtacaccgcagatcaccccttactttctgatttgcactggatctaggggcagcggaagatcagtcatttcagtatttcacattccgggaatatctaacgtatgtggcggcgtcctatggtgtcccgctgccagatgtgtctgacctcataaggggatttcactttgaggactatgccaatgttcttctatcggtcgcggatcttcttccactgcctgccatagcgcttgcccgcggagtagccgcgcgtgaaatgcttgtactgccgctccgcttccttgcgatgcttctcacagtattgctcgccgtcctcgcaaaggttcgggcagccggggtggcggcaggggcgtcttggttttctcggcatgcgtgccgcctcctttcggacaatagaaaagccccgaaaggattgctcctttagaggcttgaaataggtcgtccggaccgcgttctccttctttcggcttgttatctacgatgggcgccatgggtgcttatagagagtggttcgcggtaacgctacgcttgcaagacggttgaaacctgagtatttatttaatccagttaggcgtagtgctttgtgatgcacattggcaataaaaatcttgaaagacgataagcggctatgcgggaattactacatgaggatgatttcctacgatataccctgcagagcaaaggcaaggtatatttgtgggaaacgagtaatcaatatgcatgaacggcgcatgtcaccaaggagatggtttcgacatggacaaggatttccttgcgatttttaatgccataaaggctgatggggcgaatgcagactacaccaagcgcggcatcgatccgctctactccgtcggggctggcgctcgcatcgtggtcatcgggcaggcaccaggcgcggtggcggaagagacgcgcatcccctggaacgacaagtcaggagagcgtctgcgcgattggctgggtgtttctcgcgagacgttttatgatcctgagcgggtggcgcttctccccatggacttttattttccgggacatgggaggtcgggcgatctaccgccgcgcaagggattcgccgagcagtggcatcctgcactcttggcgctcatgcccaatgttcggctcactgtgcttgtgggcgcatatgccgtccgcaggtacctgcatctcaagaattcggacagccttacaaccgtggtgcgcgattatgatgcctatatcggccggggattcttccctttggtgcatccgtcgccgcgcaaccagctatggatgagcaggaatccttggttcgaggccgagaccttgcctgcactcaaggcacaggtcaacgcggcgcttgaacagaggtaagtggttacgaaatcatctgtgacgataacttccagccatacaaggaggttcattcatgcagagaaggacgttggggactcgtgaggcgcctgaaggcatcctcgaagatgccgcgacgccaaggtggcgagagcgttcgcgagtgactatggttatgacctccgtcagtcttctgctgcccggtgatgaatgctcgtatgtgatgggcaacccgccgttcatcggccatcagcagcacacgcagcagatcaaggatgatatggaactggtgtgcggcaaggccggaggctcgctggattatgtggctggatggtattttaaagctattgatttccttgacgggaatccctccgcgcaattcgcgttcgtatccacgaatagcatcacacaaggccagcacaagtcgccccgctattcaagcatgtggtcgaacgagggtggcgtatccggttcgctcaccgtacgttctgctgggacgctcagactacggacaatgcgaacgtgcatgtcgtcattgtcggattcgacagaggcacaaacgctcctgcgttgtatgaatacgacgacattaacggtgaacctgtggaagcacgtccggctcatatcaacggttatttattggatgcgtctgatgtgttcgtggaggcgaggagtcagaagaccggtccgtaaggtctttgccgtcccggatggaagaaattctgtaggaataaggagagcctccccaatttggagaggctctccttataaccaatctggctaccttctgattacccttggagtccaaaacagcttgatttcaagggaaactgggtataggcctcagatgtggaagtacagctcgtactccagcggggtcggagccaggcgggcctggtcgatttcgccacgcttgatgccgatccaggtttcgatcaggtcgtcggtgaagacgtcgcctgcggtgaggaagtcatgatcttcctcaagggcatccatggcctctgccagggagctcggaacctgcttgatgcctgcgtgctcttccggcggcagctcgtacagatccttgtcgaccggctccggaggctcgatgtggttcaggatgccgtccagacctgccatcagctgtgcggagaaggcgaggaacgggttgcaggacggatccggagcacggaactcgatgcgctttgcagccggggaggtgccggccagcgggatacggatggcggcggagcggttgcgtgcggagtacaccaagttgaccggagcttcgaagcccgggaccagacggtggtaggagttcagggacgggttggtgaaggccagcacggaggaggagtgcttgatcaggccgccgatgtaccagcgggcaaggtcggacagaccaccgtagttcttctcatcgtagaacagcggcttgccgtccttccacagggactggtggcaatgcatgccggtgccgttgtcgcctgcgatcggcttcggcatgaaggttgcggccttgcctgccagagcggcggtctcgtgaacgacgtacttgtacttcatcaggtcatcgcctgcgtgctgcagagagttgaagcggtagttgatctcctgctggccagcgccggcgacctcgtgatgggaacgctcgaggatcagaccgaccttctgcaggttggcgaccatgtcgtcacgcagatcctgggtgtggtcgatcggcggaaccgggaagtagccgcgcttgacgcggttcttgaatgcgatgttcggggtgccgtcgtcttcggtgtcgacgccggagttccacggagcttcgatggagtcgacctcgtagaaggagcgctgcatgctgttctcgaagcgcaccttgtcgaagatgaagaactcggcttccggagcgaaggaagcggtgtcggcgatgccggtggacttcaggtaggcctcggccttgcctgcaacctgacgcggatcgcgggagtacggctcgtcggtcagcgggtcgacgatggagaaggccacgtcgagggtcttgtgcttgcggaacggatcgacgaatgcggtggaaacgtccggcaccagcttcatatcggattcattgatggcctggaagccttccacggaggagccatcgaacggcatgccgtcggtgaaggcgtccttcaggaattcgcttgccggcacggtgaagtgctgctgaacaccgatcagatcagtgaagcgaacggagacatactcgatgccttccttgttgataagggcctcagcatcagccttggtttcaagtgcagtcacgggaccgctcctttcgaataagtaacttacaggctcttagtctaggaacgcgcgtttcgctcactcgccaattgggttacgagaatgtttcgtaatgacatattcgaaggatgatttcgcgaaaaactggggttcaattgttacgaacgctcgtatttgcctctgcaaaaccgttcaatttgtggacattcgtgtcgtcatgtcgcttgcgacgtccatttcttttctcaaaaaccttaccgcatgcgcgcaggccagcggaaggtaacggagatatgaaaaaaggaacctcgataacgtgttcatcgaggttcccatatgtaagccggctttacgattccaggaaaatcagcggccacgcatagcacgacggctgatgcgctgcgggtgcatcgggtcgacgcccttcggaatgcccatgccgttcttcatctgcagagtgcgcagacgctcgttgaggatgttcagctcggtcttggtaagcatgaagcggctcttcggatggatggctgccatcagcttgttcttgtggctggtcggctggtagctcttgcacttgagcacggtcttgcgcagattcttcaggctcgtctgattcttgccctggccgacgtagatacggtagacgggaatatcggaaccggcggtcacacccttgatattctgctcctgacggtccatggcacgcttgacgcgattgtaatcgccctcgccgagcagataaatgccgttgtaaccggtgccgcgccaaatggcgtctttggtcttcggatcaacccacaccggctcctgcggaaagttgaagccagccttgttaatgttgccgagcacgctgatggcagcaccctgacgcccttcaagcttggcgtatccgactttgtcggcacggttggtgagcatcatggtggcgaacagcaggccaagcatgatggcgaggatcatggacgtgatccatccgatcaccgaccacttgaacacgatgccaagcaccacgaacacaacgatcggcgccacgaacacgccgccgcacaaccacggaagagccttatcttcggcgtgggtgtacttgaagatctgaatgatctgcttgatggtgctttgcttcttctttggctcttctttgtctgccatcgacttcctcacttggttatgcggttactcacactggaacggtagtttatcaggaaccatgccatatcgcacggtttccgccgtttttccttgattgacggggattatcgggtatgtagaggcctgccatccgccttaagcagcgcctcgccgaacgattcactgaaggtgggatgcgggtgaatgagcctcgccgcggcggcgagcggcacccggttgccgaccaattgttcggcttccgcgatcagatcgctggcgagcgggcttacgatatgcacgccaagcacgaggggaacatccggagcgcctgccatcgcaccgctgacgatggtcatggatccgccttccccactcatgagcatacgcgagttggacaacatgggatatgcggtttcctgcggattgatgatggtttcacacgatttcgcatcgtcgagtgcaagaccgacgcttgccgcttcagggaaagagaacacgacttgcggcacggtttcgtcggataccggcttggggtcaagtcctgcgatggtttcggcgatggtgatgccctgttcaaacgcgcgatgagccaaagcatgccccggagtgatgtcgcccaaggcccatacgccctccacattcgtacgcccatacgcgtcggtcgaaacataaccgcgttcctccaattcgatgccgttggatgcgaaccagccggcatcggtgttcggcatacgtccgatagcagcaagcaccacttcaccatatgcggtgcgctcctcctcgccgccgccttgcctgtaatgcacggtggcgcccaaattcgcaccggtatccacgtaatccaccgacgcacgcgtcaccacgctgatgccgcgacgtttgagctcgcgggtcaacgtcatcgaagcccgcttctcccaagacgacagcacgcggtccttgcggatcagcaacgtcacttcgcatcccgcggcattccacaacgaagcgaattccaacgccaccgcacccgctccgacaatcaccgcactggacgggaacgtatccaattccaaagcctgcgtcgaatcgatcaacgcacctgaaaacgggttgcccggcaatggtaacggtcgcgatccggtcgccagcacaatatcttcgcctttgatggtaagctccgacccgacgggttcctccactcccgccttgaaggaacgcatgacctgcgcttctcccccggccggcgcgacatgcacatcatgaacgtccctcaactcagcctcgccgcggaacaccgtgacgccgcgatgcgacagcaatcccgccaaccccttcgtcatcgtctccaccgtggacgtacggaagtcacgtaatttgccgaaatcaatgctctgtaaggtggcactgatgcccatacgttccgcctggcgtatgttctgcgcactgtgtgcggccgtcagcaacgccttcgacggaatgcaaccacgattgaggcaggtgcctcccaacgttttgtcgcgttcgatgagcgccaccgttttgccgagctgcgcggcacgcaatgccgtggaatatcctcctggtcccgctccgatgatgacaatgtcgaaatgctgttcagtcatgcctgccctcgttgattcgtgcgttacaactggttacatggtaatggaaaagccgtcggttttcgccgacggcttgaaaaagcaactgcgattctcacagaatggatcactcgggccagtgtccacgcttctgatagcgcggcttcggcagacgccagcgacgcatctggatggcacggctccacgcgtaggaaccggaacgcatgcccttggccacggactgctcgccgaacttttcaatgagcttcttcttgagcttgcgccacatgatcacgatgtcgatgatcaccgcaaacagatagatgtacataagcagcatcaacggcaatgccaacgccggccacttgtaggtcacgaaaatcgaaccgatcaaaatgacgaaggcgaccggaatgaagaactcacccaagttgaagcgggcatcgacgtagtcgcggatgtatatacgccacggcagacgctcggacttcggcatatggttgatgtcgcccttctgcatggcatcgtattcggcgttttcacgctcgcgcatacgcgccttggcggccttgcggctcgcttcacgatccttgggaaccagcggacggagattctgcgcctgggcatccttgcgcttcggcgtcggacgccccttgccggcagtaggctccgcagccttcttcccgacaggctcctggtccgcatcttccttcttattaaacacactcatgcctatagagcgtaaattgacgtatcgacgccttgcctcattcatgtcaacgattggacgtgattggttcgacggatacaatggtcattcgatagcatgcggcggcacgtttccaagatgcgtatatgccgcatatataagaaggagcagtatggcagttttacatgccgatgagattcgcgcgcgcgtcgaaacggattttgaccgcattgtcgacgtgctgaacaagaaaatcgcgttgcagtccatttccgcaaaaggcattaccgcggatcatatgaaacagtccgcgcaattcgtggccgaagagctgaacaaggtaggtgtcgatgcgcatgtggtgcagtcgcacaatcccgatggcacgccgggcgcttgggaggtcatcggttcgaaaatcgtcgatatcgacgctccaaccgtgctgttgtacgcgcatcacgacgtgcagccggtgcccgatgccagcgtatggaacaccgacccattcgtcggcacggtaatcgacacacgcctgtacggacgcggcgcggccgatgatggcggcggaatcgccattcattccggcgcattgcaggcgctcggcgacgatttgaaggtcaatatcaaggtcttcatcgaaggcgaagaggaaatgggatcgccaagcttcattcccttcatcgaggagcataaggacgaattcgattccgatgtgatcatcgtcgccgactcgggcaattggtccgctgaaatcccctcgctcaccacgtcgctgcgaggcaataccgatattgacgtgcacgtcaaggcgctgcatcatccggtgcactccggtcagtacggcggaccgatcctcgatgcgaacacgcttgcctccatgctgatcgcttccatgtatgacgagcatggcgatttggtggtaccgggcgtcgcctcagaagatccaatcggcggactgcagcgagatatggatgaggcaaccgtgcgtacggacgccggcatcgtcgattcctaccgtctggccggcaccggttctttggccgcacgtctgtggaccaagccgagcgtgaccgtcatcggcttcgatgctcatccagtggagggatcgttcaacgtgatctcccctgaaacgacgttccgtctcagcctacgcaccgctccaaaccagcgtccggaagaggctcaggaagcacttgccagattcatggtcgagcatgctccgtttggcgccgaagtgtgggtcgacaagcttgataatggcatgggttgggccatggatccaaatgccgaggctaccaaagacgccatggacgccatggaagaggcgtttggcgtggctccggtcaataagggcgaaggtggctcgattccgttcattccggaattgcagcgtattttcccggacgcgcaggtactggtcaccggtcccgaggatccgaaggccaacgcgcacagcccgaacgaatccatcagtcttcccagcctgaaaaacaatgtgatcaccgaagcgctgctgcttgacaagcttgccaagtagcggatatcacatatctttttgagaaaaacaacgggcaaatgcgaagggcgttccattccatacaacgaatgaaacgcccttcgcaaatccgccgcgcattcaacaaacctcgtactgcgcagccctgctccgattaattgccagtgccggtaaaagcccaatgccagtaaccggtgaaataagcgcaagacaacgcaatcaccggcacggccacgcaaatcacgtaaaacagccaatcgacggcatgtaagctcgatttcctagcctggcttcgcggagcgtccgcgccgaaaccacgagcttccatggcggtggcgagtttcgtgccgcgtcgaatcgacacgaccagcagactgaacgcctgcgagaacacacgtttgacggcgctgccgtcgcccaatccacgagaacgacgggactgcccaagcgcacgccaatcatcctgcagcaaagtaaacatgcgcatgccagccaaaccgccatacacgaaacgcgacggcaaatgcagaatctgcaccagaccatcggccaaatcagtcggatcaagaccaagcgcaagaatcacgccgggaacggcaatggccgccacacgcaggaacgtggccaacgccaagtacaacgatccctgcgaaatcacaacgacatcaccgagattgaccagcacggccccggaggtcttgccatacaacgacacggaaatgaaacttcccgaagcggcaatccacaccggccaggttttacgaagcaccgtccacggagcgacgccgccaatccagagcaacaacacctccaatgcgagtgccacggacgcggagaccacgtccagcgtcacgaacatgggaatacatagtatcagcgcgccgatgaaacggctgaccggattgatttttgccacgaaccatgacggcgatgccggcttggcatcgtcatgacgttccttgtgcggtaccacgctgatggtttccaactgttccatctcactccccctcgcttacgagaacgcgacgcgctcccaacgtttcgatcaatggttcgtcatgggtgaccatgatgacggaacagccggcgtcacgcgcaccggcgatcagtttcaccatttccgtccatgtggtgaagtcttggccgaacgtcggctcgtccatcaccaagactttcggcgcggcggccagcatggaggcaacggaaagccttcttttttcgccgcccgataatgtgaacggattagcttgagcgaatctagcaagattcatacgctcaagcatgttgtcggctatagcgtaagactcttcttcgctcttacccatggatttggggccgaccgccgcttcgtcacgcacgctggatgcgacgaactggtgttccggctcctggaacaccatgccgattcgtccgagcagatcccgacttttccaagtgaagacgtcgttctccctacgtgcgggaaccatggtctcatccatgctcacacggccggaaatcggcttgagcaagccggccaaagtcaacgcgagcgtggattttcccacgccgtttttgccggtcagtgcggtgatctcgccagcatggaacacgaggttcacatgctcgccaagcgcgaagtcacgcccgaagctgagatcctccgttcgcagaacaacatctcccgacgattggctggattcgggggtatgactttcgatggtgcgtcctggaacccatgcgccgccctttgcgagcaccgatgccatgctgccgaacacttcttccggagtgccgtctgcgatgacgccgctgacatgcgagtcggcctccggcttgccgagtacgataacccgatccaccagatcaagccatacgtcaatatggtgttccaccaccaccaaggtttcacgggtctgttccagcacatggcgtaccgcatcatgcacttccttgacgccctccggatcgaggttggccgtcggttcgtcgagcagcagcagtccgggatgcatggcgagcacgccggccaaggccagacgctggcgctggccgccggacagtctgcgtgtggagcggtcaagtttcatgtagccgagtccaacaatgtcgagcgaggaacggaccctgctccaaatctcatctttcggcagattcagattttcacaaccgaaagcggtgtcatcgcccacacgttccagaatcgtctgcgcgtcaggatcctgcaacaccaatccggaacgtccgcgtgcctgacgggcgtccactccgtcaatcagcagctctccttcaagctcgccttcgtcatcgccgccgagcacgccggcaagaccggacatcaacgtcgattttccagcgccggaagcgcccaacaacaacacgcgctcccctggctgtatggtgaaatccacatgccttaacgcgaaatccttacgtgaggcgtgtcgccatccccaatcgcgtgcgaccaccccggctgcggaaaacgatttttctgcatcagtacccatgaatcgttctttcatccctcttgcattccgcgtttgcagaacgaacacgcatcaaagaagtcccgtatccaccactgtgaatgcgatacgggacttcattaacgaatcgtcataccaaggccttcgcacggccggattcgaaacggtcaagcacgcctgttttagcgatggcctgctgcagcagatacatcaggactccagccaccagagcgccggaaataacggaagtgacgcagctgacgacaatacgcaaacctgcccaagcaggattcacggtccagttatacaggaagcatcccaagccggcgagggttccagcgatggtggtcgacagcaaatcccaacgtttgtatgcaaaaatcgcaaaaccgatttcggcagtgaggccttggcagataccgataatcaaagaaccgccgatgccccacggattgcccatggcaagctccagagcagcggcaagggtttcagcgaacaacgcagcaccaggctttcgcacgatgatggcggccagcggacccgcaaacagccagatgccgttcaacaagccttcgaagcccggcgtcaccgcttcgaaaagcgtaatcggagcggcgcagatgacatcccagccccagaaaatcacgccagccgcaaccgcgatgatagcggccacgacgatgtcaacaactcgccatttattgttatgcttcttcaccacggaagattcatttacggtcatgaatgtgcctttctctatgtcaaggcacgggaaaagagagacgtccgtgcgccggcattacccggtatacgttcatacggttgaagcgcttgcttcctctcagccatacggcccccgtgtctgcgcttgatactacacaaggcacaagattttcacaagggtcatttcatttcgcttcgttttccacccagacgttccccggatgagctgtgaatccgcagccgcattaggccactgtccataccgcaggtcatgacggcctggatacgtgccccgcacatcacataggtctgtgcatcaacgattcggccagattcctgaacgtctcgccaatgccatcggcgcgcaacgcgccatcctcgttcaacacggcggggcggccggcctcaccggtctcacgcaattccggctccaacggtagctgtgcgagcaaaggaacatcatagccaaggctttcggtcaactgctccgacacacgcgcacccccaccttcgccgaaaatccgcaggcgttcgccctgatgctcgtaatagctcatgttctccacaacgccgcgtaccttcatcggtacctgcaatgccaccaggccggagcggaccgcaatgtccgaggcggatggctgcggcgtggtgaccaccaccagttccgcgttcggcagagcctgcgccacggaaatcgccatgtcgccggtacctggtgccaagtcgagcagcagcacgtcaggctcgccccaccatacgtctgaaaggaattgttcaagagaacgctgcaatcgcgggcctcgccaaaggatcgcacgatcggcgccggcaaacatgccgatggaaatcaatttcacaccccatgcggtaactggcatgagcatgccgttcagattggtgggttgcgcatgcacgccgaacagtcgcggcagtgagaaaccatagatgtcggcgtcgatggcggccgtgtcgtaccccaatgcggcaaatgtggcagcaagattcgcagtgacggaagacttgccgacgcctcctttgccggatgctatggcgaaaatacgggttttgatgcccggcttgttgaacggattctgtttgcgttcggccttgaggcctgccacaagttgggtgagcttgtcttgactcatggacccgacttcgatgcgcggcagcaatgtcgcttccggatatgacgacaccgctccgttgatctggttggtgatagtctgcgacagtggacagccttccaccgtcagttcgacctccacacgaacctcgtaggtgttcgtcttaccttccaccggtatcgcgtctatggctgcgatcatgcccaaatcggtcacggatcggcccagttccgggtcgattactttgctgagtcgctcatagatgcgcgcttcgatggtgcgctcgtcggtcatggttcctcctttagccgcgtaccagactagcgtctggaagcgcggcatgccagagccttcttgtgattacgttgccggcttgatatggcacgcgtcacaccgttccgttttccagcagcagtttgaactggtcctcgtccagcatggcgattcccaattcctcggctttggcggctttggcaccagcgttttcgccgacgaccacccaatcggttttcttgctgaccgatcctgcggcctttccaccgcgggagataatcgcctctttggcggaatcccgcgagaaatcaaccaacgaaccagtgacgaccactgtcttgccttccagtgtctgcggcagagcactggtctgtgcctgtccgactcccactccagctgccttccatgcttccagcaccatgccacgccaatcgcctggattcttggccgaagcaaaccaggtgaccacggattcggcaatttccggaccgatgccgtctatctgtgacagttcatccacgctggcttgttcgatggcgtcgagcgaaccgaatgtgttggcgatggtacgcgccgtgggaggaccgagccgccgaatggacagggccacaagcacacgccataggtcggcatggcgcgccttgtccatttcgtcaagcattttcctcgtgttttccgcggggcgtatatatatcggctgcacactggatgttccggaacgcgacaccttggtttcctcgcgaacgaccacggcatcttcaggcacgtcatattcgggatattccgcggattcgtcgacggagtccttacgttttctcgcaactgtaggagctgtccagaacgccggaacctgatgccacagtcccgatccgccaatgcgtttgcgtatctttttcggtttgccgttcttgccgatggtttcgtggatttcgatgatcggcgcttcacgccatacgcgaacatcctgcagatcggcggacgtcaacgaaaacagaccggcttcgctggacagcaccggtgtttggcgggccggcagctccagaccttccacaggctcgtacggttcgggctccgcgcccggctccaccacgatttccgtgatgttcggcgcgtaggtggccgtcgaatcgggacggtcctcttccggattcgtcaaagcgatggcggattggtcgcctaaatgctcgatatcgaacgctttcctggatgccagattgatgatgcgttcggtcaactgtgccgggcaggattccacgttcgggcagcggatgtccttgtccccctctttggccggagcgagttccgccccgcagctcgggcagtgcgaaggcatcacgaaacggcgcagctggccttcgtgtccttccctgcgttccagcacaggacctacgagttcgggaatcacatcgcccgccttacgcaccacaacggtgtctccgatgagcacacccttgcgttccacttcgaatggattgtgcaaggtggttctcgacaccgtcgaccccgcaacatatacgggcttcaatatggccactggggtcacacggccggtgcgccccacctgcacggtgatgtcaagcagttccgtattgacttcctccggcgggtacttgtaggcgatggaccaacgcggagcacgcgaggtcgcgcccaacgatcgttgcaatcccaaatcatccacttttacgacaatgccgtcgagcgcgtgttcgatatctccacgatgctcgccgtagtaatcgatcatgtcgagaatctggctgaatgtggtgacctcacggttatgtggcgaaacgggtatgccccacttcttatacaacccatacgcttcggattggttgttgaccgcatcatggtcggcaccacgtttggcgccccactggagcgttccaatgccatgcgcatagaagctcagccttctggtggcggtgatgcgcggatccttctgccgcaggcttccggcagccgcgttacgtggattggcgaaaggcgcgcgcccagcatcctcgttttctttgttgagcgtgttgaaatcgtcccatcgcatgaagacctcaccgcggatctccacgaattcgggaatgtcttcttccggtcccgcaagattctgcggaatggtagagatggtgcgcacattgagcgtgatatcctcgccgatcacgccgtcacctctggtcagaccttgctcgagcacgccgttacggtagatgaggttaagcgcaagaccgtcgattttcacttcgcatgtcatcggcaaaggcttcgtctcaggccaatcaagtccccgaataacaccgtcgtaccattcatgcagttcctcaagcgaaaagacatcgtcaagactcatcatgcgagacgggtggcgtaccgatgcgaaatcattggagaaggtgcctccgacacgatgcgtcggcgattgcgcggaatcgagggatgggaactgggcttccaacgcctgcagacaacgtattctcgcatcataggcggcgtcggacgagaccggcgcgtcatcgatgtagtatgcgatctggtcggattccacccacgccgccacacgcgcccacaatcgagccgcggcttcagcactgatggacgagacatcaagtcgggtcaaccgcatggcgtcggcatcggttggctgcaatgcggcgatccagcgttcactgcccggcgcatatgagctgactcccccgtcgggaaccacagcggttgacgcggagcccgtatcgccgcccatttcagaagcgtcaaaatcccatgcgagttgttcggaatcgtcatgccttgtcattgtcattgccttgtcactgtcttcaatgttttgccggtcagagccgccatgcacacattatcgcacaaatgttcgatttgctgcatcgccaacgtctgtttggcgcactgcggaaagcacgccgttcagttgttcaacgacctcaggaactgcatctgcaccacgtcggcaccgtcgcgctcctcgtcatccatccttgaagcggcaaccgaaagcgtacgtgccggcacgaacatgccttcatccacacagacccgcgcggccttgcgtaccaaggatgcgacctgggtattgggccataccggcagtcccgcttgggtaagcacgtgcatggcttccggaacgtcggtgggcaccggaatgcattgcgattgcgcgcgtccgatcaattcctgcagctcgctctccagcatggcgattcgcccgggggcaatctcctcgctcatgatgtacgcggcggccgcgatgtcgaagtggtcgcacatccattccgcataggcgagtctgtaataggcgaacgacgcatcctcacggtcaagtgcgacgtgcaacgcgttgaggcaagccgctctagccggatcccaatcctcggcgcgcgccagttgaaccgccagcttgagatgggaaagcgggtaggccggcgcatatcgcaccatcgcattgagatgcggcaacgcggccttcacgcctttgacctgtgcaagcacgtcggcgagttccatatgcgcgtagaacagattgtccggaatcagcacggtccgttcgccttccgtggcgaacatgcgattgtagatgacgcgttccgcatacgagttgaaataccgcggcacgcccggattcgaagcgaacagtcggtccattcgccccaacgccgcttcggccagttccacgctttggtcgacctgtcctgagaacagcaggtctctcgccttgatgcgttccgcgtcaagctcgtcggccaagcggaaggagaagtccggagtgtctttgccatcgatgagcgcactcgtcacctgcggagccaacgacgtcaattccgggtcggcaatggtgttgatgacgtccatggcctgctttgccttggccaccgattccagatgggagtcctgcgcgattctgtggaattcgccaaccgcgcgctgcagcaggtcgacgcgctgaatggacaaccccgacatgtcacggcagccgaacagctgtgccgtgtcatggtcgaatatggcgtcggaaagctcaggctcctcctgacttccggatggggagaaacgactatcgcgcaaatcgaacgtggcgtccactggcttcaatgcgccgaggccgtccacatccatttccgcatcgaacatacggtatgtgcctgttggatcagacaatccgcactcgcccagacgctccatgaattcgcttctggtgaaggtgaccgtcaccagattgcgtacggtcggattcttgcgaagctggcttaatggatcatcaccattcccatcgaaatcgccgaagccgatcagtcccgcgtcaagagcgccatcatgcacgccctgtgcggaaccgtcgtccacgctagaggaatcgttcgcagtctcgtcgggaaccgcgaacgtcacttcgtcgaagtcgatatcccgcatcagatcctcgaattggctgttcaacgcatcatccgtatcctcggagttgacgccatcaacgcccatgtcggcggatctcggcgccaccggacgggacgggtctccgtggaaatcgccgtccttcggatcggccttggacccagaaacacccatatctccagtacgaatgcgttcgaaagccgccaaagcctcgctcatcagctcgctgatggcggaatcctgctcggccacggcctcttccaaaccaatcgaatcgatatgcatcgacacacgctgtatgcccggatcggcgccaaaactcaacgcggccatcatcagtccaacacgcagattgtagtccgcgctcatgcgggcacgttcggcgtccgtcatatccacccatgcgtggcgggacacgtcatatttggtggatggcatcatggaaacgccggcagaggtgaaaccgatggccatattgccgtctcggagactgcatcggaagtccacgtcgaagcggtatggcaggcgcatgctgcgcaatagtctcgacattgtctggcggtatacccattccgaaccgccttcggctccgaaggcggtaccatcctcgccgtccttcgtgttttcggcgatggaacgtctggtttccgcggcgatgtccaccaggcgcatgacggcttggacgccgtcatcctgctgtgagtcgaggatcgcgccgaattcgtcgtccggtttcaatgcgatcagcgccggattttccagtagcgccatgtcgatttgcgcggcttccgcgcgggttacggtgtcttctgtgggcagcctgccgatacgggcgttgcgttccagccatgaactgactgcggcgaaacggttgaggttgccttcgatgttcagcgcgcgcagcgatgccgagaacggcagtgtggaatcccaagcgaagaaatagcagcccgagtagctggacgtgtataggtgcaatggttccgcgccgtgtactgcttcgagcccttggtctttgtcaagggcgcctgcctcgcgcatgaggtcggcgaaataatcctcaagtccggatgcgcgcatgccatgggagcgtgcgctcatcgtgtctctgatggatcggcggatcgcgcccatcggcgcctctcggttgagcctgcggaagatgttgcccgtgccgaatcccacgagtagcccgttcatttgcggcagcatgtaggctgcgaagaatgcgatggtgatggcatccctgtattccagatcgaatcgcatggtttccggcaggttggcacgcatctgttcgagcgtgtagcggttgccgactttcagccaggatgcgagccacatcatgcggccaccgggcatgcgtcccacgacaccgccttgcgacgcgcgcaccatcttcggcgcgccgtttgtcgcgtgtccgaatcgtggaccgtctggcagggtgagggtttcttctttgacgaatatgaatcgtggttccagatcctgcacgtccatttcgggattggtgcccgcgaagacgcgtgctttgctgtcggcgagcgcgatttgcgcgaagtggttgttgtcggtgaatagtccgatggagaaggctttgccttgggtttgtggcagttgcgcccagccgagttggagtgtgcttggtatgccttcgaagcctttgatgatgcgtcgtttgatgagtgggttgagtttgatggcgttgcgggtgagttcatcgacgatgtcgtctggcgtgtcgagggctttgccgaaggggttggcgtcggcggtgttgtgggggtgtttgttgtggttgatgagttgtcgtaccccttgcatggcgtggttgagcatggtccgtccttggtgtggatggtgtgctgatggcgatgctggtgtgaggtgtgacatgtgggccattctttcaattcaatgcgacatgcagcctttagaataaagttcgtgactttttcgaaacagcgttttcaggcgcgtcatcgtgtgtgcgcagctattgtagccgcttttgttgtggtggtgttggttgagtgcgtgttgtgtaatgtgccgtttttccgctcgttggcggcgtcgggtgattcggcggctgcgtataacacgttggggccggggcttgagcgtcgtgatgacgggttgttggaggttactgatccgacgcaggcgtatttgcaggtggctgcggatggttcgtctgagtatgtgcggatcgtgccggtgtccgatgaggttatgggtggtgtgcctgccggttcgcgcgtgttgcgtacggtgcgtgttcgtgcggatgcggatcgtgtggctggttcgttgtgttcggtgtcgttggattcgtctcgttcgttgtatgtgagggctgcggccggtcgtgcggtgcgcgtgcaggtggtggaaccgaaggggtcattgattccgtttgatgcggttcgcgcgaatgtgcgtgtgccgttttcggtgagtccgttgcgtgtggcgttgttggtgttggtgatggtgttggtggcgttgtggcgtccgggctcgcgcctgtggaaggtgccgttgaatacgtcgagtgtgcgtcagcgtgtgacgttgggcgtgttgttgacggttcctgggttggtgactgttgcggcggtggcgtggcagttggtgtctgcggtgccgttgagttttcatacggatggcatgtatacgtatgattacgatcagtatgatcatgtggctcgggcgttgcttgatggtcatgcgtggcttgatttggatgtgcccgacgcgttgcgcgatgcggataatccgtatgatgtgacgactcgtcagcaattgcttgccgatggtgtgagtccggtgtattgggattatgcgttttttgatggtcgttggtattcgtattttggcgtggtgccggcgttgctgttgtttgtgccgtatcgtgcgataacgtcgttgtgggttgatggtggtctgatgatgccgtctggcgctgcggtgccgctgctgatgtttgtttttttggtgttcgcgtgcctgttgacgattcgcgtgatcgagcgtgtgcgtccgcatgtttcgctggctgcggtcagtatgttgtgcgtgtttgtggttttggcgtcgaacgccccgtacttgtggtatcggacgaatttttattcggtgccgattgcggcgtccttgttgttgagcacgttgggcttatggctatggatgggtgcggcgcacccgaacgcggccgatgccggtggcgatggtggtgcgaatacggtcgaatcgttgtcgctgcctcgtttggctgccggttcggtgtgtattgccgcgaatgtgggttgccgtccgtcgtttgtggtggtggcgtttgccgcgttcccgttgttctggccgcagattcgtgcgattgtggggcagttgcgtgccatcgcgtctggttccggcgtgcgtgggcgtgcgcgcaccgtgttgcatgcgttgcgcacgcctttggccgtgctggtgcccgcattggttgtggtggtgcccttgttcgcctataacatggtgcgtttctcctcgccgttcgatttcggttcgtcgtatcagctgacggttacggatatgacgagttaccatcagtcgtggtcgaattttgtttggacggtcgcatattacctgtttctgccgttgcgttggacggatacgttcccgttccttgccgtcgatcccgcgcctttgaaggattgggggtttgcggaggcgatgcccggaggcctgttcgtcatggttccgcttgctttggctgcgttggcttgcccgttcctacgtaagcgcatgcgcgttcgtggccatgccggcatgtggcccacattggtgatgttcctgctgttgggtttgctgatcgtggctcttgacgcgcggctgggtggccttggatggcgttatatcgccgatttcggctggctgtttgcgttggcttcgcttcctttgatgcttattgcgctggattgcgaacgtccgcggcttcgctggctgttgcgcgtgctggtgttggcgctgctgttgttcacgttgtcgttgacggtgttgtcgttgttcctgtacggccgcgacgacgagttgattcgtaataattccggtttgtttcatgacgtgcagtcgtggttcaccctgatgtaagttacggcgttttcagggttatttcagggttttatcacaatttttccaataaatcattcggcttgttccgagttttgcggataacagtggcgatgtaactgttcgctgtgagatgaacccttgttggagacatcagtcatgaaatcgcttccacttttgtcgaaccatcctcgtgtaagacgctggaccgcggccgtcgtcgcatcagccgtcgcattgggcgtctgcctcgccagctacgacaatgtcgatgcggccatcaaacaaaacaggattgaacgactgaacgcacgtatcgagaacgtgtacacagccgactatcaggatatggccgacgacaagctcgagcaggaaaaaagcaggtcctccgcaacagaggatgacatgtttgtcaccgaagatccgtacggcaccaacaccacgtcactgtatgtgtatttcactaccgacgacgcggttgccgtctcctataccgtgcatgcagacggctatacggatttcacccgtgacgcctatcaggaatcgcaatacagcaaaacccacgaattccagctgctcggcctcattcccggcgagaagaacaccgtcgccatcacgctgaccgatgccgacggcaagtcccgcacgcatgccatcgaacacaggggcgcatccctgctgggcaatgaggaggtgcagttggagaagaccgtcgcagccgattcaggtgaggatctgggcggcggcctgtatgcgattctcggcaatgattccgacgaacaggatttcatgttctactacgatacgaacggcgtgctgcgcggtgagattccggtgctctactatcgttcgcaccgtctgctgttcgatgatgatggtctcatgtggttctccgcgtccacgcatcatatggtggcgatgaaccgtctcggcaagctggagaagatctacgatctgggatccgactacattctgcatcatgattatgcgatggattccaacggcgacatcgtgctgctggccaccgagctcggccgtgacgacaacgccgtgcaggatcaggtcatcaagctcagcacttccaccggaagtgtaacccgcttagtggatttcggtgagctgttcgccgactataaggcctccaccacgcatgcgggaatcgacgagtcggattcgaatgccaagaatcgttgggattggctgcactgcaataccattcaattgttggatgacggttccgcattgttctccgcccgtgagacgtccaccatcatcaaggtggatgatttggaatcggatccgacgcttgattatatgatcggcgagccatccgtgtgggccggcaccgatgaggccagcagtttcctgacgaagtccggtgatttttcggataccggcggccagcattctatcacgtatgtcgccgatgattcgctgcctgacggccagtattacatgtatatgttcgataacaatttcggcacttcgttgacgcgtcctgattttgactggtcggtgatcgacggcatttcgaccgaattgtcgtccgatacggcaaattcgcggtatcgcaagtatctggtcaacgagaatgccggcacgtatacggaagtgtcgtcgttcgacgtgccatattcgccgtatgtcagttccgcgcaggaattggataatggccagatcctcatcgactcgggcatgaagggtctgttcggccagtacaacaaggatggtgatctgctggcgcagttcaagatgacgttgaacagtgcgtacatctaccgcgtgtacaagtacgatttctcgggattctatttcgtctgacatcctgtccgcaggcttgacggggccgggaatctaaactccttgtgggggtttggatttccggccccgtttcgtatgcaatgggttcggcacgcccgtacaatggttgccatgggttttttcgattcgctgttttcatccaaacgtcccgaagcgacgcatgacatcacgttcacgctagatcaggcaggccacacgtatgaggatggcaatgtcggtctggagccgacatcgttgacgatcactccggaaagcaaacgtgtggctgtgatcgggttgaatggttccggtaagaccacgttgctgcagctgttggatggcgcattgtctgcgacgtccggttcggtgcgtatcgacgcgaatggtgctgcgtatgatccgtcggtgaaacgtgatctgaaacgtatcgaatcgatgatcggccgcgttcgtcgcgaggaaattccgaacagttattacaaagcggattccattcgcgaggcgattgatgaaccgttgaagaagcataaggtgccggaaagcgaacgccaggcgatcatcggcaatctgttcgcgcatttcgatctggcggcggtcgcacgtgagcccgcctccgcattggatagcgagaaacgtcatctgctggcgatcgcttccgcattgagcttctcccccgcggtgatcgttgccgacgagccgaccaagggtttggacgaggtggcgtccgcgcatgtggcgaaagctctgttcagttacgacaaacaggtagtgttcgccacgcatgacacggagctgatcacacgcgtggaatatgcgatcgaccgcacgctggtggtcgacgatcatcaggtggtgttcgacggtggcccgcatgaggccgtggccttttacacggacctcatccgcgctaaatatgaggcttccaaagcctgaccatacccacggattattcccgttccccacatgttgcggctccttcatcggtgtcgacgatggaaccacaacatgtttcagccgatcattgtgttgacggtgtcaagcaccgtctgaacgttatgcctgaattcgtcgggttccggcaataacgagatcgcgagatagccgttcgacgtcatatcgaagaaatagccgggctgtcctgaaattccgtgcttttcgatcatggacaacaccagttcgttctcgtcaagcacgctgggcacgcgcaaaagcacattccatccgccttcggcacgcaacacgctgaccatgccctgctcgtcatcatccagcatggtatgcaaggctgcgaggttggtttgcacgcgctctcgcacgcgcgcggtctgcgcggctgcggcgcccagcatggcggggatctgtttggcgatgatctcactcattggcagatagtcgtcggcgaccacgtcgagtctgcgcttggcctcatccacttcagccgccgggccggacacttggatccaacccactttggcatgtggcgcggccaacgtcttcgagaacccatccaatgcgaatgtgagcgtgccggtctcccccgcgagacgcgcgttgccatcgaatggttcaagatcatagtcgtagaacacctcatcggcgatgatggccacctcatggtcatgacaaagccgcacaatggcctcacgttccgacgctttgacgtacgatccggtcggattgttgggattgatgagcaccagcgcgcggatgcggccgccatcttcaccttcaagcgcttcgcgtagttcggccacgtcgatgtaccaggatccgtcgaaacgttgctggtactcgatcatgtcgacgcattcgagtcgtgcgatcgattcgatgagcggatatcccggcttcggtgcgagcacggcgtcacctgcattgcagagcagtttgatcagccatgagtacgcttcggacgtcgagctcaatatgtataggtcgtcggcggtagcggtattgccttgttcatgcaggaatgcggccagcgcttcgcgtgcgtatcgttgtccgcgtggctccgctccgtagatgtccggcaatagttccgacgcgagcgcatgtttggttggattggagtcgttgagtttgccgagtgtgatgccgtttgctttggcttccgcttcggctttggcgatgggattgggctcgctgatatcgactctggaggaaaaacgcatggtctccaccatactctctgggttgcgcaagtgttgcatcgagcaagaaggatgcattcgccatgcgatcatcagaggaataacaagagccgtccgacggatgaatcggacggctctcgcttatatgaaggttaggaacctttatggttcacgacatcacttctgcttgatgcttgcgtagtacgcagcgccgatgatgccagcctcattgtgcagcttggctgcgacgatcggggtcttgatgtcgatgtacggcaggaacttctcggacacgcgggacacgccaccgccgacgacgaacagctgcggatccaagtagaactccatcagggaataatacttggtcagacgcttggcccacttcttgtagcccatatcgagcttttcacgaatggaggatgccgcgtacttctcggcgtcacccttgcccttgagcagttccaaatggccgagctcagtgttcggaatgagctcgccgttgaagatcagcgcggtgccgatgccggtgcccagcgtggtggcgacgaccaagccgtcctggcccttggctgcgccgaactgctgttcggcaagaccggccgcatcagcgtcgttcaccacggtgaccggacggccgcaagcttcggagaacacttcggtgacgtccacgccaacccaagactggtccagattggccatatagccgagcttctcgccaacatgaatcggagcggggaatgcgatgccgaccggagcggactcaggaacctcaaaatgctcgagctgctggcgaacgatttcgccaacggccttcggagtggaaacctccggggtgaggatcttcagacgcggttcagcaaattcgcccttctcgaggttaaccggggctgccttaatgccggagccgccaatgtcaacgccaaatgcctgtgcagtttcaatcatcttcgacctctcctatcaaggtacatagtgggtatatcgaaccggtaaacgccatagtaactcgccccatgccccaaaacgcgccgacaatacacaattggtgaatacgattgcataatctgtcgcaatgaaacgcaaatatttgcgattgttttctgcaaacgattcgccccatgccaacgcaacgcatcggcatggggcgaatcataagaaaataaccgtctgaagacggtgtagccacattacttgagcggcggcatcgacttccaatccggatcatgcagcagcttgcgcgaatcccaccaacccttggcaatctgcaccaagccggtcttggcatgctcacggtccaccatcaccaagcgaatgacctccttggcggcggtcagcaacgtgccaaagccgaacatcagcggacggtaatcgccgaacgacatgaaatagcgtgccatgtagccacggttgcgcatgatgtggtagcggttcatgtcggaagtggagttgagctgacgcacgccggcgatatcccaattgccgatctcgcgcgtacgtcgcaggatcacgtcgggcaccacgatcggattggtgaccttgctggcgcgatagccgtacatcgtatcgtcccagtagatgaagaagcggggatccggcaaaccgatctgttccacgatattgcggcggaacaggccgccttcaaagcataaggtgtccatcacacgatagccgggacgcccgaacgcggccggagcgatcggattgggaatgccaagaggcacgatgaaatcgtactgccagtagaacgggcctccgtcgtagtcgtatcggcttccctggatcacatcatggctgccggtccacttggcgagcctttcgatggcctcaggcatcacggccacgtcgtcgtccatcacccagaaccactccgcacccagctcgtatgccttcttcacacctgcggagaagccgcctgcgccgccgaggttgtcggattgcggcgcgtacaccacacggctttcgttgcccgactggtcggcgatggtattgccccactgcgcggtgaccgcttcacggaaatcgtcgaccatgccttgggtcgcctcgctgtgctcgttgtccacgacgatgatacgccatggcgccacagtgagtttttcgatggattcgaacagggtggcgagcagctgctgacgcctgtacgtcaccacgacgatagccagcttttcgatggtgttcttcgcaacttgcttttcagtcatacgttccattcttgcactcgccctcaaccgaacatcgcctgtgttcgcatcatgcggcacgattccattcgacggacgggctcttgcacatttcgtgcggctttgccataatgtacggcgtaatgcaggggaacccgtgttcgtcgggttgagatgggccaagtgaggcctgaaccctttgaacctgatggttaacaccagcgtagggaggcatgtctagtgactgctgtgacatcaacaaccgatttcgattatgagttcgacgccgccaaaggcatccaacgcgacaatcttccgccgttcgcgcagcgcatgcgcaaggccgccgacctggtttgggaggaaggctaccagcagccgttcatccgcgagcttggcgaaggcacactgcaacgcgagcgtttcgccttctatctgctgcaggattttcgttatgtgaacgattacgccagagtgcacgctttgggattagccaaggccaccgaccctgaaatcatggcgttcatgctcaaggtgcagaacggcgccctgcaggtcgagaccgaagtacaccgctcctacttggccagctatggcatcaccgaagagcaaatgaacaatgtgcgccagtcggccttcgcgcgtgcctacacgtcgaatatcctttccatcgcctatggcaaggatattctcgacattcttgtggccgtgctgccgtgcgcctgggtgtatgcggattatggttatcgtcttgccgccgagttcgcggacacgctcgacgacaatccgtacaagagctgggtcgacatgtataagaccgacgagttctggcaggattccgtgtggctgctcgatcatatcgagaaactggtggccgacgcgagcgaggagcgcaagcgcgagctgatcgacattttcgtgaccggcgtggagaacgaatacatgttctgggccagcgcgtacgacatgcagtacacatggaagcccgaatggaatcaggcgcgctgatagcactccttcatggggtttcctgacttccgattgtttattttcattgcagcaaggcgggtgtcttctgattggttttcagaaagcacccgccctgttatgtttggtcgcgtcagtttcccgctttattcgcgtacgaggcggatatgttccacgtcgtcgcgatgggagcggcggtagagcacgaaacggttgccgatgacctgcacgagttccgcgttcagttcttcagccaatccctcgcctgcttccttggcggtcagaccggatccgtcgagcacggagcacttgatgagctcacgcttttcgatggtttcgtccgcctgcttgatggcgttttcgctcagatcgttcttgccgacctggatgagcggattgagcttggtggccaggcctcgcagctgcttgacctgcttcttggttaatgccataacttgttccattcctatctatgatgcttgctcaagagtagcgtgaggacggtaaaatccgccgactgccttcagtttagtccagcgatcagaaccaacgcagccacatatgccacaaccacaccgcccgcggcaatgtctcgtttggcgatgctcatcacgcgccaatgtgtgcgtgcgataccctcttcatagcatcgcgcgtcgagtgcgagactgagattgtcggcatggcgtatcgcccctgcgaacaccggaatgatgatggaaaccatcgccttgatacgctgcacgaacgttcccgtttcgatgctgccacctcgagccgcctgtgcgtccgcaatggctttcgcctcgcttcccagagtgggcaggaaccgcagtgcgaggctcatcaccagtgcgatctcctgcgcgtgtacgcctatttttgcgaagggtttgagcaaggcttcgaacgcgtcggtgatggccgtaggcgtggtggtggcgaggaacaccactccgacgataatgaccgcaacgaatctgcaggcgtacagtatagcgatacgcacaccgtcgtcggtgattggaatcggtccgatgttcgtaagaacattgccggattgtacgaagaacacattgagcagtccgcagaacacgaacaatgcaaggaacatgtgaatcgatttgaacagttgtttcacgccgatgcctgatgtcgcaacgatcatgccggtcaacagtgcggccacgagcagctgccagaaagagcggatggcgaatgcggagaacatgaccgccaacgcgcccaccatcttcacgcgcgggtcaagccgttccataaaactgcggttttcacggacgtctccctttgcatgtccggagccaagcgtgtgcagattcttcgaacctgccgattcgacagcagaaccaggctcggcatcacgaacttttccaccaacgttccggtcagcgtcaagcgcgatcgtccggtcggcaagtacgtcgatttccgcttgcgaatgggaaatgatgagtatggtgatgccttgtgcgtggagggtttggatgagattgtgcacgcgggttgtggccgcttcatcaagtcccgcggtcggctcgtccataatgagaatccgcggttggcatgcgatgacgcccgctatggcaacgagtcgttgctgcccgccggaaaggtcgaatggcgaacggtcggcaagatgttcaatatgcagcaatgccatggcttggctgacatgttcatccacttgcgcttcatcaagccgttggttgcgcggaccgtaggcgacgtcctcggctacggtttcggcgaaaagctgacgttcgggatgttgcatgacgtagccgatggtggcgcgcagtttctcgcggtccgcacgcttgagcgactgcatattgccgttggcgcgttggcgtgcgacgggaatggtgttgacggtaatgctgccagattgcggctgttccagcgcgcagagaagacgcgcgagggtggttttgcctgcaccgttatgccctgtgatggccacggtttcaccctcattgatggttatggaaagcttatcgagcacaggcttgctactgtttggatattgatatatcagattatggatttcaatgattggtacagctgatgttggcttcgatgcgccatttgcaatattggatttggcaattgggttgtcttcttgcgctgtgcctgattcgtccatttccggaatacttgcagtattaccgcgagcgctttgcacgatacgcccgttatccaggcgaatgatgcggtcggcattgacgaattcgtcacgatggtgggtgacgagaatgatggttgtgccgtgctgctgcaattcgtcaagaatatgcatgatgtcggcgcggccttgcggatcgagcatggcggtaggctcgtcgagcacgaggatttcgggattcatggcaagcatgccggcgatggcgacgcgctgctgttggcctccgctcattcgcgtgggatcggcttctcgttgtccgctcatgtcgactgcgtcaagtgacatggcgatgcgcatatcgatatcatcatgcgcaatggcgaggttttccggaccgaaggcaacatcatcctcggtaatggtggtgacgatctgatcttccggatgttggaaaaccgccccgataccatgccgggcgctgcggtaagcgtcagcgtgcgcgccggagtcatcgaatacgttgtttcccaacaacgtgacatgtccggcatcgggtgcggcaagtcctgcgatgatgcgtgaaagtgtggatttgcccgatccgtttggtcctgccaagcatacacgttcgccttggcgaacggtcaggttcacgccgtcgagcgcccaggtcgcgccggagtcgtaggtgaaacgaatatcgtgcagttcgaccgcgatggtgttcgtggcgctgtcaggattcatggaaaaagtctttcataaacgaaaggaaccttccatacgtcgaaaggttccttcctattcatcaatatgcggaatcgatatggtgaacgaggctcagcggttcaacaggttggagatcggcttgtagatcaggaaggtgaccacgccatggatggtgaatttcaacgcgttgaacggcagaagcgccggcacgatcaatgccacgacctgtgcggtggtcatatgcgcgtagaacggtgtgacgattatattgcccacaatcgccatcgccaaggctgcgatcgcaccgacgatgatgccgatgaccgcgcctttgcgggtcttgttcctgcgatagatcagtgctgccggcacggataatgccaaagccacgagcacggccataagcgtgccccatgggttggtaaacaggtgcggcaggaaaccaagcacgctgacgattaccgccgccgctggcccgtaggcgaaacctgccaccaggctgacaatgccggatggatcatatttcagccattcaacgcccggcacaatgggaaattccacaaagctgacggccatcgacagcgccacgaacagcgcatacatggcgatgcgtttggtggaccagcgtccagagtcggccacgcctgtggaatgcgcgttgtcggggcgcgtcatgctttcgctagcgatttcggcgtcgttgttttgggtattgtttggtgaggatacactcatgttgagccccgtttcttccatccggactttgaccgttggctccggattctcaccggatcagccgctttcgcgggtcgcgggcttcggcatgggaccgttatgaacgtcagtcgtaccgttaccgccagtaaggattttcaccttccctgaaacttgcacgattatatatacgcctatcgtcggaaatatgcaaaccgcgtctcactggcgtctattatcagcaggcatcaatctttaatccggaaaccatgatcttagcctcatatgccttttgcctatggcatgaacgtcgcctcatggtgtgttgccgcagtgtgcgctttgcctgttgctttcgtatcgtgtgcgttcaagcaagcggcaggtacgttgattgttatgccagcaggtcgagcaagtcgtctttgctgagtgtgccgacgcctccagatgcggtgccgtcggtgaactgttgggcaagctcgcttttcttctcctgcagtttgaggatgcgttcctcaattgtgtctttggctacgatctggtacacgttcacatcctgcgtctgtccgatgcggtgcgcacgatcggtggcctggttctgcgcggccgcgttccaccacgggtcggcgtgcaccactacggacgcacccacaaggttcagccccgtgttgcccgctttgagcgagatgaggaacacgggaacatcgttgccattgaattcgtccaccagttccacacggcgtttcttcggtgtctcgccggtgatggtgtagaagtccacgccctgttcagccaaacgtgtaccaatcaggtcaaggaatgaagtgaactgcgagaatacgagcactttcttgctttcgtccatgcacgtggatacgagttcgcaaatagcgtcaagtttggcggaagcgtttttcgcatccgcatagacgagtctcggatcgcaacagatttcgcgcaacagtgtgaattccgcaaggattcgaatcttcttcgtattgaagtcggcgtccttggttttggtaagggtggcgcgcaaccgttgctcgtgcgccgcatagagtttgcgctgttcgccttccagtttgacggtgagcacgttttcgaacttgtcaggcaaatcggtcagcacgtcttttttcagacgtcgtttaatgaacagtccgaccaaagcctgcagtttgtcagccatgacggaatgttcagaaccgggtgccatgatcggctgttcgtatttttctcggaacttcgtgtaggttcccagcaatccgggcatgaggaagtcgaagatgctccacagttcgctcaaccggttttcgatgggggttcccgtcaatgcgaaccggtgttcggcggtgatctgtttgacggctttcgccaacttcgtggcatggtttttgatgtattgcgcctcatcgagcgccatcaatgcgaaccggcaggcggcgtaatcatccacatctcgacgcagcaaatcgtaagaggtgatcaccacatcggtttgctgcgtttcgttggtttcagtcgaattgttccattgctgtgccacggctgcgatgagcttgcgccgttgcgctttcgtgccggccacgacttcgatggtcagatcttgcgtgaatttttcgcattcggcggcccagttgtataccaaggatgccgggcagacaatcaacgctggaccgctccccttgcgagcttccaccagtgacagcaattgcacggatttgcccaaacccatttcgtcggcgagaatgccaccgaaacctttgtcccacaaggtggaaagccattggaagccttccacctggtatgggcgcagtacgtttttgaggttgcggggcacttcgtatcgtttcgggtcgatgattttcacatcgttgacatagtcgacgaacgattcgcttttgccgtcgtcatcaacttgagcatccaagaggaacgcccgatatccgggaatggtgattcttccggaatcaagctgtttctcatcaaggtcaagatctgtggcaatctgatcaagttcatgcagatcggcattcttcagatcaacgaacgtaccgtccttgaatcgatggtagcggcggttcctgcggtaggaattcagcaacgcgccgacctcgttcatcggcacttcgtcggctatcggcgaaatctcaaccagattcgagtcgatggacagtccgaccttcaccgtagggctgcctggcatcatcatgccgtcgaacgcggccgtggagaacacctgcccgaccgaacgcaagatatccacgccttcggtgagcaagagcagaatagtctgttcgtcttcctcacgaatccgcgccacgtcaatggaactccatgtcgggaaaagctggcgaaccacctgcaccgcgaatgattcgcgagccgtatctcgtttgatgagcgccgctttcgaccgcgagtccggattaatcacgcctcgtagcgctttggcggtcggcaccaactggaacacgaaatcgccgtatcgtgccacagcctcgcaggtgatgccctgcagatcacggtccaagtagaattcgatctggcagtcgactcccatccgttcggcgacttcctgcggaatatcgaaaccaatgcccgcttcggtaagttttggcagtattgttcgtgcgaacatgggccagtcgttttccgcaatgaacacaccatcgctaacgttcgacgcgcacaatgtcatcaacgcgtccactgcgggaaggatgctgtcggtacaacggaagagtccgctcactggcatcatatgggaatccgtcggagtgccgttatgctcggcactcatgaggtacacgccccgctgcccaacaatccgatccgtgatggtacggttcgacgtgatacgcacgcccgacgaagcgccttccttcacatattcggcgatgaaccgaaattgcggattgccatcgaatatggcgatagtatgcgacctggactcccctggcgtggccacttcgacatagcccggagcggcgtcatccgtatgggcgaaatcatccggagtgagctgccgcgccctctcacgcccctcatgcttgggagcttccagcggcccacgtgctatcagcacgtcttcgatgtagtcctgttgcggttccgcttcgaacaggttcagtagatcgcacaattccccatcggtgagcatgatttcacgttcgatacgcacgtctggcgcgtaatagtagttgttctgcagttgcgctgcggcacgtgatccaacaacaccttgcaggaatcggaacagctgcagcgagaacggttcgagcatgtccggagtgtgggtgaacgagagtttctgtccgtatgacacgtatgccccgttgtgcatgtcggctacgaatttggaaatgcttttgatgatataacttgcgtcgccgcagccgattttcaacgtcaggctccacagctcacggttcatgatcagcgtgggctccagacgcacgcttcccggtttcactatgatggaaccgctcttgcgttttgttttcgtggccccttgcgtaatgacgcctcgttgctcgtcggcgagacggcttttcgcgtcgacgatgcgcttgagcacgtcaagctgcgcgctttgaccggtattgtcattcttcgcatccagcgcacgcatgtagtcggagaggatatgcgaggtcacgccacttcgcttgaatccgcggaaccgttcgggctggtcaagaaacagcagcagcattgcggcgacatgcttgcacatgccagtatagcggcgccccccagccggatccgaatcgaactcgtcatcgtcctgcacatgaccgaacgtcgatcctgaaccgaaatcatcataatcatcgacataatcgtattcatcgtcatcatcgtcgaaactgcgataatttggattgttgcggtagctgggcgaatatgccgacgaatacgtgccataaccatgctgcgaaccgttgaacgcggggcaggagcaatacctggccaagaaaagctcatcatgcaaatcaagcgtggcctgcacttcgtatcggctggacggtgaggtggtgccccgcatattggcatgcagggtgatgcggtcggaatcggagtcgttcaggcaatgcagatccgacattttcgcacgccactggttggcgattccacgggcacgctgcaatacaggctgactgcattcgctgcgtagttcgtcggaaagccatgacaaagtatccgccaactgaaccccaatcgttcgcacatttgttcttatgaaagagtatcagcacagcggaacaggaaagccgtggctgcaatcccagccacggcttcgctccataccggttatatcagcggcaacgcttggtgagcggctgccatggatcgagttccaccggttcggattccagcagcgcgagggtggcgtcgtcacaattcgatgatgtccgtattgtccggattgctggccgtggggttggttgtcggcttatcggttggatccgcgttggccgtggaaccgaccgataataccggtgcaggcatgagaaccgctataacctgtgcagctgcgcgatatcatcgcgcagctggttgacggtgtccgtcagttcccgcacattgtggcgcaactgttccgtttccgattccgcctcatccgcacgcttgtcggtctcgtcacgaacacggtcgacaatccatgaagccagcgtcgcggtgacgatgccgatcagggcaacgccggttatcatcagtccgatggcgatgcatcttccctgccatgtcaccggagacaaatcgccatagccgactgtggtgacggtcacgaacgaccaccatatcgcttcaccgaaatcggtgatggaagcgcctggaaccccacgttccacatccaattcggcaagggcgccgatatacatcagtagtgtcacgctgcagcatgtgtacagtgtgatgcgcccacgcaccgccatgccaccggtacgattgagcacgttgagcactgccaccagacgcagcagtctcaatggcctgaagacgggcaatgcgatggacaccagcatcagcagattgtctttgaaccaggttttcttatcttccgccagcaggatcgaaacgacgcagtcggcgatgaacaccatccagatgatgttgatcactatttcacacaacaggatatgcgtcctcgccagaacttcccacgaatacgcgaacaggaacaccaatgccaatgccgtcatgaaccattccgtcgcacgacgccatttgttcaatgtcataccctttcctttcttcccgactgccatcatacgggtctccccgcacgcgcgaccgtcagcttttgatgggcatgagattgtcgagcgactgaccgttggcgtagcagcggacattgcctaatgcaatggagatgacactgcgttcggtgatctcaagatggttgcctcccgccacatgtggggtgatgaggcatttcggctcacaccacagcggtgagtcggccggcagcggctccggctcggtcacatcgagcgcggcgccatggattcgtccttccgcgagcgcgtcggcaagcgcctgactttcaatggcgtcgccgcggcccgcgttgatgatgatggcgtcaggtttgagagatgcgatgcgttccgcattgagcaggtggtacgttgtcggagtggatggtacgcacatggcgatcacatcggcgtattgcaggacgtcgtcgagggaatcgaatcccacgacgtggtcgatgccctcggcctcgatgcttggattgcgacgtacaccgatggtttccatgccgacggctttgcagagtctggcgaaatgcgacccgatgtctccggtaccgatcataagcgcggttttgccgtccggagtgacggcccggcctgcatcatgccatatggcattagcgtttcctgccgcgtagatgtgcaggttcttcatgatggcccacatcatggcgaacatgtgttcggagacgctttgtccgtaggctccggtggcattggtgagcatggatccgggctgcaggatgccgggtcgctggtatttgtcgacgccggcactccaagtttgaagccattcgagtttggggcattgcgcgcattcctcgggcgcgatgttgccgatgaccgcggtggctttggctttgagctcctccggtactgcggcggtccagctcatgcttccccgttgggccgaatcgccgacgaattcctgtggtatgtctttcgcggcacgtatgaattgcgcacgttcggattcggtcaacggcaggcagttgacgatcaatttgcggtcgttccatattcccatgcgttttaccctatgacaatcgtcggatatagggtttcacgttgggttctgggtcagacgccgagttcgtcggtgtcaaggatgatggtgacaggaccgtcgttggcgagccgcacgcgcatgtgggagccgaatcgtccttcttttacttcgagtccttgcgcgcgcagggcgtcgttgaatccgtgccatgtctgttcggcgtgcgcgggcgctccggctttcacgaagcttgggcggttgcctttgcgcacgtccgcgtatagcgtgaattgggagatggacagcacactgccgttcacgtcgtggatggaacagttcattttgccgttctcgtcttcgaagacgcgtagattggcgattttgcgggcgagccagtcgatttgctccgctccgtccgtgtcttccactccgacgagcagcacatagccgatgcctatatgctgtggttcgaatgtggtgtcgacttctccgcttgtctcgtcgaccacgtcgacggatccttcgctgaccttctgcaatacgatgcgcatattccgtcccgttcttttcatccggcgtagtcgacgatggcttgcgtgacctgtttcaggtagtcgagcgacgtctgccagtcgtccggcacttcgatggaatggttggcaccagcgtacgtgcgcacatggtcggtgagcagatgcgctttggcgtcatcgtagtatgggtcggcgtcacctgcgcagattagcggcatcgggctgccggcagttcccggtagcggcgcgggaatgaccgacttgtgcttgtcgaatggcggcgggttgagcaccggggtgagcagcaccacacgtaatcctagttttgcggaatgcggatatgagagtgtggagagcgatttggtgacgaccagcaaatgcggctcctcacccgattcggcagcatgttcgagcgccgccttgcgccattcgtcgaccacgcgttccatgcaggcgatcatttccggaaactcgacgctttccgtcagtttcaggtcgagccggtccacgaaccatccgttggccgcaagtgcctgcgctgcccagtacagcagcggtcggtctacggtgtatccaatgcccggcatgatgagcacgtgattgccggtttcggtgttcttcacacggttcttaccccatggggtgaccgccggtgtgacgtttttcgttgttggttgcgtgccgttcttgcccatgctgtgtttgattcgccttttcatgtgttccgtccgtcttggccggtcgttgcggccggcgtcgtttcccatattgcatgctaggcggcgccggctacaatcgtttccgtcagttcaccgtgtattggttgttatggattttcgtgtccatgtcgttcgtttcggcgtcgtagatgttccagctgggttcctcatcccgtatttcatggcggcctcttttcggatgactacgttcattgtatgaagcattgaacgcacagcggtcgaaacggccaaaacatcagccgagcagctcatacacattgcgcatggcgagcagcccgtccgtcatccaccggtaggcttccgtcatgtcaccggagaaatccacatcacgacgcacccaaagatgccagtttttcttgtcggattccggctcgtcccacatcacctcgcccagatttgccagtatccgttcaacggaatccctcatggtgtagagcttcgcgtactggaacgtgtcggtgaagtacagatcgaccgcaatatagccgcctcgaatattcaacgccccatccgggtgacagaaacccaagcccacaccgaaactcgtccacgtgtcactgttcgtcttgcggccggacggatcgccatacacgtcgacaaagtcgagtcgcgttgcggcatattcgtacaggccgttccagaagctgcgccgcagcgagatattgccgctgacttgccgcagttcgtctaaggttctgccgtccgcaactttccacactatccaaccgttgatctgcttattctcgccggtttcgagcattctggcgcggcggaatgcgccggatgggctgtcgaatatctcgccattggacaggcggatgcggtggtcttcggttacggttgccgtggcggttatgccggcataccggctttccagtgcggctccggctgcaagaatgccccacttgcatagatcagcgaaatcaacggcattctgttcgcgttccccctggttcacgttccgattgcgcagagtctgcataaccccattccccgctgtggggcgtgcccacacctgcaatgcgagatcggcaagtcgggtgcctcgctgcgcgattgcctgttcgttccatcgcgaagcatcgtgcagttccacggaaatggataggtattcgttatcgtatccgccgaccgcacggttcttcttctgttcgaacgttccgtcggaaagctccgaattgtatgcggtcaacgtcagattgcccaaactgttcaccagcagtgtgaatcggtcggggtcggcgagcatattgcgccattcggcgtgcgccatggcgttctgcggcatgatgtgttcgatggtgtattcgttgaaggatcgcggatccttgggatggttgtggttctccaatccggcgagcagatgtttgcagcgcggagccgggcggtacagatcctcgccgagcagcgcctgcctgaattgttcgtctgtgggcatgcgcgtggctttggcggtttcggtgagcagcagcgcggcgaaggtttcggccaaatcatgttcggctgattcgagtttggcaatcagagatgggacgagtttgttcaatccgttgctggacaccgagcagatcattctgcggaacagatacgattcaagatccgtgagcatgcgcagcagtccgtcgcggtttgtgcgatggtgcttccacgcagcgaacatgtacataaccaatgaatccgtaaccgtgctgtccaggttttggatcgattcgagccgacgatccacgttcatgtcgccgctgccggcagccgcaatacccttgataacggcgtaatacctggcatattccagcatgttctcgagaagatcgcgcgtgcgttccatgcgcggcagggagctgctagctgcgaaacgtttgaactccgaatacatggcgcggcctttgggcacgggcttctgcagcgtgacgaccatccagtcgtgcaggaacgcgtcgaatgagagactgccgagagtacgctccataggcagccagtaatcggcatacagggtgttctgctcgaccatggggcaccccatgagcatgtagttgcgcaccaggtctgaagtctcgagatcaagcccagtggaattcatcgattcgaacaccaattgaggttcatcacgcccctgatccagggtgacggacacgacttcaaggcgttgcagaccgttccataccacgttcgcatcatcgattgcggcgaccagtgaacggaataaatcaagattcgtttccagccgggaacccgtatcggcatggttcggccgatctggggcgaccacatggtcgcacatgctgcgcagcacttccctatcatcaccggaaagcgtcagcttgtagcggccttcgccggttgcatacttgtcgacaagatagccacggtcgatgagcatgtctgcggagaatcgcaggttctcaggatgttcgcgagcatattcggccagtgcgataagcagcagggtcaccgaggtgaggcgctgctggccgtcgatgagcagacaccggctgacaccatccgggccgatgccgccctcctgcatccatacgaccgacccggtgaaatgcgttctctcaggatgcctgccagccgttacaatgtcggcccacaattgccggcactgcgtctcgccccatgagtatctgcgctgatacaccggtacaacgaaccgaagcgaaccggtgaataagtccagcaggattttcttgccagcgtccatggtgcacttctttcctcttcaccttcgaaccaaagtacagctaatgatcacactaaaaatctgattcactagacaaacttactacacagtgaatttgctccgccatacggcaaattaagcaagtatcacagcaactgttccacctatcaacatcactcagacgcttcagagctattactccacgctttgactaaatcaacatcatcggaatcaggacgtgaatattcctcataatcaactttaatcaacgacggcattccaaatgcacgtccagtcaatactgcctcgccctttcctaaagtgggaattcgtgatttagagaaagcatccaaagttggcatagtattttccaacatctgcaaatccttgtcgtttaccaatttatgaataatgtaattatgaatctgagacataattgtcggagaaatatctgcaggacgttgggatgcaatcgtaaggaaaaaaccatacttccttccctctttaatcattgattcaaaggtagttagacgatagtcttcccacacatcggaatgagttgatttgaaagaattgagaatattatgagcttcatcaattatcagatgaaaggaaacacaggttggatcatattttttcttttcataaaacattttcgaaagcaataaggcaaatgttcctttgcattccatgtcaacattttttagattaaagacgcttattccttttgcataacattcagtggcgttttttatcacagcgtatttcttaacagaagagaaaagactctctaaccttcccactacgggttttaaccattcaagctgcattcccttatacattgcatcatatattttttgaaattttatgaaaaccaaaaaagaatcaaataaatcaagagattcgcctttttcttttaatttttgtcctatagtttcaagtttcaaatcactagatggaatacatgacacataatttccagagttatcgtttttttttaagagaagatttctcatctaaagaacgcccctgattaataaatccagtcccatcattagttaaataagacaagctatctcctttgaataaggaaactgtctcaagtacattcatgcaatcaattttatcgtcggaattttcttgcagcacgtctcttgctacgctacgccactcctccacaagcgcgatgtcacaacgctgcaaacatttttttaaaagtcctatttgcatatcagagcatatattcttcttatacttctcccattgtttcaaagttctggacagaaatggagattgtgtattttcggtagctttagcaagtatttttaatacgttaatattaaagaaaatattttcgtcaatcaaaattttttgttccgcaccatcaaaaacatttacctgacactttccaaatacttttccgcttccatactcaccgttaaaatcaataactgcaaaactactttcccttaaagcagccttaccatacggagaattgaatagttcaagataaagtttgtgcaaagtatttgatttaccgcttcccgtattgccgaaaataccgatatgtgaagcaaaaaaatcgttaatcggaattctaatcggctgattttccatgagcgaacggccaatagttacagacttctccttctcaacaccgcgcgaaaaaatagctgcaatatcctcagaagatgcagaaacaagaacattacctaccataggaacagtagaacttgtgacggaaaaatgtccttcttttatcacaccttgagatttgactttcactatcctctgaatcgactgggcatgaaagcgattatcgaattcctttgaattaatggtatttaattgatcacgcaccttttccgataaaaccgttactacaatacgattccgtccctgcttaaggattgcataagcgccaacttttataccgttaacctcttcaccatccataaaatatgaagcgccattggtcacgttgtacatacccacagttgcttcatcggaatcaactgacacaacaacaccgagctctttttcacctaacttcatgaacttccccaccttttaggcgcacttcagttttccagtaataattttattaaagttattgaaatctaatcgactatatccttctcctctaaaagaaaaattccctggatgcaaaaaatataaatttgtactcttagataaatttccgagattcgttttgattattttgacatcactgtctgcgtaagccacaatgacgacaagtagttctctattctccagcgccctttttaaagcatgagcaatatgattatccccgaaggaaaaaccatgtactaaaagcaacgaaccattaccaacgtttcccgtgttttccgacatttcatattcaaaaaaacgcagcatttcataataatgcttcttaagagttgtgtactctggctcgcgaccgttaggctcaaccgtctctcttttccgagggttatccctaacaacgtgatcacaaacctgaatcacatcttcggattgtttcttccaattcaccgacccatgaatctttgcaagatttattgatggtaattcatttatataattatcaaatcttcctttataagcagtagtagtatcaaaattcgaattatctaataagcgcttaaagtagcctcgcgcgccatcattaaaaatgaaaggagcagttgacccactctcataaatatcatcaactgctttttcgatgaataagtcataattagttgtaaaaatattgatatttttatgacgctctctcgaattgacattaccgagcatgtcaagaagaatttcaacaaattttttatatgtagataacgtgccaagaatagcttctgattcttcttcagagagtttctccttcatttcagcgcctatcagaaacttgtttctcttgattatttcgtacattagaccatttatatctatgaggccatcttctttgtcttgaaacttgctcatcaaaggcattccgggagaagatgtccccgagccgaaaagaaagcttgtctttttctcggcaatccaatcgggcagacgctctataatttctttttcggataaaggcatgtcgtctcctctaaagccactctttgaagctaaggctaacactcatgcctctaataacacaccactttggaatgctcatatatatacttgaacaagcaatgagtgatctaccccctaggatgacatgacagacaacgacaaagcccaatacgctcagctcattgacttcaatgcatacccggtgaagaatgtactgggtatccttctgcaagacaaaagtacaaaacagaacatcatctatgcgaccgacgcgtacgtgaatgccgaaccagccgccatggaaacagcacccatacttgcccagcagatttcaggtgaagcccccactgtccacatcgttccgcgagttcagaaaagtctgaatgagcaggctgggcgcaccaaggcgaaagccgaggtgttcacgccgtcatggatggtcaaccagatgaacaacaatctggatgaggaatggttcggacgcaaagacgtgttcaaccatgagaatgagtacaatacgtggacaccgtctgacagtcctattgatttttccgacgaggaaaaacacggttggcatgattacgtcgacagccgtcgtatggagatcacttgcggcgaagcacctttccttgcgtcacgctatgacgcggcgacaggggaaatcctgccgattgaatgtcggatcgggctgctggaccgcaaattgagggtcgtcaacgagaatgccggcgaggacgattggctatggtggaaatggacgctccgggcgttccaaagcgtgtatgggtatgagttccaaggcgacagtctgctgattgcgcgggcgaacctgctgctcaccttctttgactactaccgcaaccgattcgacgatgagccgtcgatgaagcaagtgaaacaaatcgcgaacgtgatcgcctggaatctatggcagatggacggattgaccggagcattgcctttccaggaagcatccgagaaagacacgtgctttgatcttttcgatgctctcgacgaaatggatggagcaaccccgaaagacacacccgtaaaagtgcatatacgcgactggcgagcgaaagaatcgttattatataagcaattagaaaaaggacggaaacaatgaagtttgattacgtaatcggcaatccgccgtatcagctttcctatggggattctgaatcagggaacaagacctatgctccacctatttaccatgcttttatggatgccgcgttcgagatctccgatagaacggaactcatcactcctgccaggttcctttttgacgctggttccacgcccaaagcatggaaccataaaatgctcaacgatcctcatctcaaagttctggactacaaggcagatgcctctacagtcttccccaatacagacatcaaaggaggtgttgccatcacttatcatgatgataatcatgattttggaataattgatactttcaccgccttcaagcctcttaacacgattcttcacaaagttaggccttttcttgaaaaaggaaatcttacagatgaaattttcctacaaaacaaatttgacctcgatgaactatattcagattttcctgattttaaaaaataatcggcagcgaaggaaaagataaacgctttcgaaataatatttttgataaagtttctattttcactgattcacctacttcaaaagaagacattaaagttctcggattgcaaaataagaaaagatgctggaaatatataccaagcaaatatgtcgatcagaatcatgaaaatcttaatacctggaaggtcctcgttgtacgtgtcaacggcacaggatcattaggagaaacattaagcacacccgtcatagctggtcccggtgaagcttacacacagaccttcattggtttgggttctttcagagaaaaggagcaagctgagaatgcgcttaaatatataaaaactaagttcctcagagttttgcttggtgttttgaaaattacgcaagataataaccgagaagtttggcggatgattcctcttcaggatttcaccgacaagtccgacattgattggtcgaaatccatttcggaaattgaccagcagctgtacaagaagtatgggcttgacgatgacgagaccgagttcatcgaatcgcatgtgaaggagatgaactgatggcgtttttcgacatcaccggcaaggtcaagagctcacgtccggcactcccccagatttacgcgtacaccactccggaaatccgtcgtcatgacggttggacgaaaatcggctacaccgagcaggacgtggaaacccgtatcgcgcaacaaacccatacggcggacgttatcgcgaaactcgaatggcatgggaacgccacctacgaagacaacggcaaagtgttccacgataccgatttccatgcatatctgcgcaaactcggcgtcaaggaccagcccagcaccgaatggttcgagatcaatccctcgaaagcgaaggaccggttccatgagttccgtaagaaccacgggattctcaacggtcttggagcctccgactatgagctgcgcgccgagcaggaggccgcggtcagcaaaaccttggactattttcagttgcatgagaggggcgagttcctatggaacgcgaagcctcgtttcggtaagaccctcgccacctacgatctatgcaagcgtcttcccgcgccggagaaagatggcatggcaaagcgtattcttgtcgtgacgaaccgtcccgcgattgcgaattcctggtatgacgactacgtgaaattcgtcggcaccgattccggctggcggttcatcagcagcgtggacgccttggcgggcagaccatattgcatcagccacgatgaatacctgcaacttgcaagcaagggcaggctgccgaactccatcgaattcatcagcctgcaagacctgaagggctctatcgagttaggcggccattacgacaagctgaagtacgtggcggaatacgactatgacttgcttgtcatcgacgaggcgcacgagggtgtagacacatacaagacggacgtggcgttcgaccatatcaaacgcaggaacacactgcatctgtccggaacgccgtttaaggccatcgcgaacgataagttccctgaggacgcgatctacaactggacgtacgcggacgagcagcaggccaaaagagactggaaagatccggaacgccgcaacccgtacgagaatctgccgaaacttaacatgttcacctaccagatgtccgacatcatcgaggacgaggtggcgcagggcatgcagatcgacggcgttcagaccgaatacgcgttcgatctgaacgagttcttcgagacgaaggacggacggttcgtccatcacgacgacgtgaagcgtttcctcgatgctctgaccacgcagaagaagtacccgttctccacgccagaactgcgcgacgagctgcgccacacgttctggatgctcaaccgcgtggattccgcccgggctctcgccagaatgcttcgacagcatgaggtgttcaaggactacgagatcatcctcgcggccggtgacggcaagatcgatgatgacgaggagaacgagaaatcgttcgacaaggtccgcaacgccatcgccaaggcggagaagggcggggaaggcgtcaagacgaagaccatcaccctgtcggtcggacagctgaccacgggcgtgacggtccccgaatggactggcgtgctcatgctgtcgaacatgaagagcccggcattgtacgtacaggccgcgttccgcgcgcagaacccatgcctgttcaacaggaacggcaagtacctacgcaaggaaaatgcgtacgtgttcgacttcgatccggcacgttcgctgaccgtgttcgaagaatacgcgaacgacctgtattccggtaccgcatgtggcggcggtgacactgactcacgcaagcagaacgtgcgccggctactgaacttcttccccgtaatcggcgaggatgaagatggcgagatggtggagctggacgctgaacaggtgctgtccatcccacgcagaatccattcgcgcgaggtcgtgcgtcgtggtttcatgtgcgatttcctgttccagaacatcagcaacatcttccgtgctcctgccgaagtgatcgagaccttgcaacagctggaaccgtacaagaccccaaaggaagatcttggggtcaaggaggacaccgccgacgaactcgacatcgacgataacggcgaggtgtccatcccggacgagcaagtcatcggcaggtccacggacctgttcggggacaaggtgtacggcgatattgacgatgagctcgattcagtaatcggctccatcgtctccgagaaaccgaaagaccccgatgaggatttcctcgccgatcttcagaaagctgttggcgccagcgtcgccgaaccattggtcgagaccgcgaagcggaactatggctccgacatgagggcttcacagcagaggaagatcgaacgcaagatcaaatcggatgtgaacatacgtatcaaccgcgagtacggcgattacaacatcgagaagaatcgtatcgaacgtgaccgcgcgcaggcactcaaaaatgccgagacctcggccgaagaagagaagatcaaccaggcgcatgacgaacgaatcgaggctgctcgcctgaatcttattgataatctcaagcagtcacgtagcgaaatggtccaatccgctggcgagaccgtggtgcgcgaaatcgagaccgcgaagaaggaagcccagaagaacagcatcgaggatagcatccgcgaccatctgcgtggcttctcccgcacgattccatcgttcctgatggcctacggagatgagaacaccacgctcgactcgttcgacagtattatcccggactacgtgttcaaggacgtgaccagcatcaccgtggaccagttccggcttctgcgtgacggtggagatgtgacgaaccgtgtgaccggcgcgaaagaacatttcgacggtcatctgtttgatccggtcgtgttcaacgattccgtgctcgaattcattcacctgcgtggaaggcttgccaactattttgacgagtcccacaaggaggacatcttcgactacgtgccacctcaaaagaccaatcagatcttcactccgcgcaaagtcgtggtggagatggtcaatatgctcgagcaggagaatcccggctgcttcgacgatccgacctacacgttcgctgatctgtatatgaaatcgggcatgtacatcaccgaaatcatcaaacgcttgtacaacagtgaggcaatgcgtagatacttcccggacaatcacattcgtctggctcatatcctcgaacatcaggtgtacggcattgctccgaccgagatcatctatcaaatcgcaactcactacatactcggatacaacaacgaattaggcaagggcctgcacacgcatttcgcgatggccgactccgcccaactcgcaaaggaaggcaaactcgccgagttcgtggatgagacattcggagaatagctgagtcactttccaccaacgatgacgatgggttgggtggctgtcagacagtttgtctgacag

SEQ ID NO: 77 - DNA, 110411 bp, Bifidobacterium pseudocatenulatum
  misc_feature (20089)..(20188): n is a, c, g, or t
ggcatattctgttcacgactgtaagcttggccaaacggccttgagtgtgtcgtgaacagaatatgccgccccttcctcggacaccaaaaaacttaagaaatactatttttcggcagtgggcatgagcaggtcgacaatgcgcttcatgtcgtcttcggatttgaacacgatttcgatgcgtccatgctccttggatcccttgatcgacaccttcgtgccgaacctcttttcaagaccgacctgcatcggcgttccggcccaagggttcagcttattggttttcgctttcttcggctggtccgattcagcgaccttcatcgacacgatttcctcggtgctgcgtaccgacaacccttcggaaataatgcgcgtcgcaagctgttccatgtcagcttccgtcggtaatccgagcaatgcgcgcgcatgaccggccgacagcaagccggaagcaaccttcttttgtacggtcgcaggcagattcagcagtcgcagagtattggcgatttgcggacgcgacttcgacaccgactttgacaattgcgcctgcgtcaagccaaaatcgtcgatcatctgctgataggcggccgcctcttccaatggattcaacgcaacgcgatgcaggttttccagcaaagcgtcacgcaacatatcgtcgtcggcagtggttttgacaatcgcaggaatcgttttcaaacctgcgatctgcgatgcgcgccaacgacgttcacccataatgagctcgtacatgctatccatgcgcccgtcgaacatattgtgcgactcggcatctttagcggcgttctccttgcgagcagcctcaatctgcgcgagtggacgcttccgtacgacaataggctgcagcacgccgacttctttgatggaatcggcaagctcacgaagatcatcctcatcgaaaatggtacgcggctgatgcaggttcggtccaacatcactcagtcgcaattcaacgagataaccgccctgcaccggcaacagttcaggttcgtcattcttcttatcttcggtcttttttaccgcagcggtttcacgtgaaacactttcctgcctcacttcggaagtggcaacaggactggtggaaccgaagaacatgtcggcaggatgagcagtctcattcaacgtgatggaaggcatactggctcgatggccactccccttcttggtttcacgtgaaacgttcttcttcatgtcatggacggcatcgacggaagccttggcggttgccacggaactcttgaccgcggtcttccccgcggattgcccggcaacagtcgcaccaccggctacgttttctgaaacctttccagcgatcttgctatcagcctttgcacccgcaacagccacagccggttcagtagcggcttccgatttcgccgactctcctggaagagacggaaacagtgcgccgagacccttgcctaaacgtgatttcgtagccatgatcagttctcattccttcttgcatcgatagccttcagcaccgtctgcgagcgacgtgcgatttccaatgcggcctcacaataggcaatcgctcccattcccttgggatcgtaggcgatcacgctttgattgaagcttggagcttccgatattttcaccgttcggggaatcgtggtattcagtacgatagtcggataatgatttttgacttcgtcatgcacttcacggctgagtaacgtcctcttatcgaacatggtgatcagcatggtggaaaccagcagcgacggattgaaatgctcctgcaccagtccgatggtattgatgagctggccgagaccttccagcgcatagtactcagcctggatcggaatcagcatctcatgcaccgcacacatggcattaattaccagcaggccgaggcttggcgggcaatcgataatcacgtagtcgtagtgctcctcgctggtttccagaaactcgtcaaccgcggtcttcagaagcacattacgattttccatgtcggcgacttccagctcggcaccgctcaaatcgatcgaagctggaaccacatcgagcagatcaaaatcagggcatgtgcgcttgacttcggcgatggtcttcctgccttcgatcacgtcgtacaccgaaggctcccccgacgcatgcggagcgcccaacgcggtcgacgcattgccctgcggatccatatcgatcagcagcaccttggaaccgaactgagccaacgcagcggaaagattcacggccgacgtggttttgccaacgccacccttctggttggcgaccgcgatcaggcgcgtctgctccggctttgggcaaacggccttctgcaaggcgcgatagcgagtcgattcgtcggcaatctgcgaaccaagaggagaatccgatcctccgaaaattcgtttgatggtttccgttgccgattccatcgatgtcaggttatctggtccttcaggtccagtcatacactagccttccttacgatatgcttaacattcaagtttcatcattcgggtggacagaatcagctcatctcacccactgtgcacaaatgtgaatagctgtggatagtcggtggataacttacgttgttcgcaaaaagttatccaccgatctttcgttgctacttcaacatttttccgccgctttttttcgtcgattttccagttgtggacaatgtgcataactcaccgaaatggtggataacttactttttatccaccatgagcacatgggtcgattccaagcccggaccaacctcggcatccaccacccgcggacgaatgccaccgcatttggcgatctctttggaagccttttcgatctcctcttgcgcggaccgccccttcagtgcgaccaaacgtccaccgcgctcaagcaacggcagcgtccaccccgaaagtttggtcataggagccacggcacggcacgtcaccacggcaaacggatgtttcgcctgaataggcttgccatccaaatccagtacaggaccgcgaacggccactcccctgccgttcttgccgcctttgccgttcctggcgcttccattgccacgattgccgccttgagcgccagcagcacccgcaatggcctcgatcatctcattggccctggcacgcaccacggtaacgttattcaactccatatcggccacgcactcgttcagccattcgacacgacgttccatcggctccacaagcgtgaaccggtgatccggcaggcaggcggccgcgacaataccgggaaaaccgccgccactgccgatatcggcaaccgtcttgaactgcttcttggccgtggcttcctttacgaaaggcacaatggcggccgaattcagaatatggcgttcccaaataatgccaacatctcttggcccaatcagaccgcgaggttcgccttcttcggcaagtttcgcatggaaaacacgaagcttgcccaacgcatcccccagcacttcctcaagcatcggcgaatcatcaagttcgtctgtcacatcactcatgggcaccatcctatatcctgttcttcctcattgtcggtattccagcaagtacttcccgaccattgacggcaatatcacatgtccggcgcacagccagcatgaagtcactcaaaaaatcgcaataaaaaagcgccaccaaatggtgacgccatgtttcacgtgaaacgagccgaactcaggcctcatcctcgtcttcagcatcttcggcagcggaagccttgagatacaccgtgacgtaacgacgcggttcctcgccgtgggaacgggacttcatgccctcctcacgcaccacatcatgcacgatcttgcgttcgaaggagttcatcggcttgagatcaaccggctcccccgtctcgcgcacctcgtcgatggcgtccagcgcgatgtcgtgcagacgctggcgcttgcgcttcagatagccgtcgacgtccacaatgagatgggaacgctcgccggtcttctgctgcacggccagtcgcgtcagctgctgcagagcgtcaacgacttcgccgttgcgtccgatgagatgcttgatgtccgtatcatcatcggcgacgatttgcacggtagggcgattgttgcgcacgcccatttcgatatcgccttcgtaatcgacgatatcaagcagtccttcaagataatcggcagcgatatcagcttcctcgttgagctgatcgatggtcttttcctcatcttgcgccatagtggttgtactcctttgagcggggtttctattactaaagtcttattgtgtaaagtctaattcctgtttaccacgtcgacaataaacgctgataaaagtggtgtgtcccgcgtttcacgtgaaacacgggacacacttttactcacttctttttctttttacggctcggctgctgacgctggtagccgctcttttccttcacttcggcggcttccttggccttctgcagcgcctcttcctcgagggatggcagaccggccttggctcggcgggcgttctcatgaacatgatcacgcttttccttcgcttcggcggccggagatcccggagtcgggaagacgtggatctgccagatggaacgcaacagattgcagatgttgttggtgagccagtacaccagcacagcgaacggcatggcaataccggagaaaatgtacatgatcgggaacatccacaacatcatcttctgcatcatttcggtctgcttgtttgccgcagactgagccatgttacgcttcatgctgttgtactgcatgaaccacaggcagaagcacatcaatgcaacgaagatggcgataactactttgccatgcacggcggcggtcgtgaagttatcagccacgttcacaccgaacactgtggtggacgtgaactgcttggctgtggcgatgtcgaaagcgccaagaccctgtccgtccctgaatttgccgcgtgcgatgtacggaatggctgacagcgtatagaacatgcacatgaatacgggaccctgcacgaacatagggagcatggaagtgcagccacccatcgggttcgcatcattgtcctggtagagcttcatcatctcgcgctgcatggcttccttgctggcgggatcgttcttgcccttgtatttgttttggatacgctgcatctttggctgcaggacggtcatctgggcctgcatcttgcgcatacccttcatggacttgtagaacagcggaaaaacgcatgcctggaccacaagtactaggaatacgatggacatgacccacgagaaaccgatctcgttcatgcccagcatcaccaggaacttatggaatacggccatgatctgcgtcatgagccactcgacgggatacaggagcttatacagccagccccagaaaccgctgtcgaggaggaattgattttgattcattacaggccagtctccttatcgcctataggtttttctacgttcagaggcgtgagccgaggttcctcgtgtgccttcgaccacgaacatctgtaaaacaaggaataaagctgcggaacgtcgtcaattcccccacggttccactgattgcagcgaagaaggcgcaataacgcaagaaggccacccttaaggcggccaaatcgttcaatcgcctgaatcgcgtaattggaacaacttggataatatctgcagcaaggcgcggtattcgcggaaatatgacgttggtaccagcgaatggcacgaatcatccaatttccgttacgaccggcgttcattaccgacgcacggccttacgattcaccgcttcaaaacatgctgcgatctgctgttccaacgatagaaaatcggcatgcgcagcacttggcttggcacgcaacacgatatcgcaggattcaggtaaggcagattcgtactttcgtgcaagcacgcggaaacgacgcttgacggcattacgcgtcacagcgttgccgacagccttggaaacggccaaaccgacacgtcggccccgcatcgccgcagaatcgtcgataatggcatcgtcgtgcaccaaataatgcacgacgatgtcttctcgcgataccctacgacggcgtttgagcaccgcgacgaaatcgcgatggcttttcagccgttccaccgctctatgccgttaaatcaggcagcgagggacttgcggcccttggcgcggcgacggttgatcagagcgcggcctgcgcgggtgcgcatgcgctgacggaaaccgtgcttcatgtgacgacgacggttgttcggctggaatgtcctcttcataattaatgctcccggtgttttttgccatgccaaggcacggctcctcatgagtcaagctctactaagttactctgacccctgaacagagatgaatgcgcatatcaaatccttcacattttcatggggattctccccacaaaacaatccacagaaacgttgatatgtcgccaaactccccacaaaagttatccacaaactacaatgatgttattcacaattcagtcttttcaacacgcttaccggtggataacttggggaaaagagagtacaaataaacagttgcacacttggaaaaagtctgtcgagaaaggggaatccgtggccgacacgacaactgaccctctcgagcaggctcggggagtctggtccgacgcgctggcgttgttgcaccagaatccggcgctgtccatccgagataaaagctggctggaaaacgtttttcccgaaggcatgtggggtcctaccattgtcttatgcgtgccaagcgcggccgcacagcagacgttgcagaacgaattgaaccagcccctgctggaagccttgcgggaagccgccgaacaggatattttccccgcattcaagattgtggaaaagaaggaaccggcccaacctgccgtcgaggaatacccccacttctcccccgcgccacatgcggaggaaaccacgcaggggcagctgccgattccggttgtcatgccgccggagcgccacaacaacttccaacgcggccaaaacaggcctttgctggatcctaagacccatttgaataagaacgccacgttcgacaccttcgttcctggcgattccaatcgtttcgcacgtaccgtcgcgttggccgtcgcggaaggttccggtcacgatttcaacccgctttgtatttacggcggatcaggattgggtaaaacccacttgctgaacgccatcggcaattacgcactggtcaaggatcccacgctgaaagtccgttatgtgaccagtgaggaattcaccaacgaattcatcgaagcgttgggtgacaccaaccagaattccggtcaaatcaaggaattcaaccgtcgctaccgcgaagtcgacgtgctgctcatcgacgatattcaatttctgagcggcaaggacgcgacgcttgaacagttcttccatacattcaataccctgcatcaggcgaacaagcgcattgtgatcgcatccgatgtgcctccgaaggatctgcagggattcaacgaacgtctgatctcccgtttcgaatccggcctgaccgttgacgtcaagccgccggatctggagacgcgcatcgccattctgcgcatgatcgcccacggcaccaacgttcaggacgatgtgctcaacctcatcgcggagcggttcaccgagaatattcgcgagctggaaggcgcgctgaaccgcgtgaccgccatggcatcgctgagcggccagccggtgacccgcgcgttggcggaacagacgttgcaggactttttctcgaccgatgtggagatcaagcccaccgacatcatcacccaggtggccaagtacttctacattacgttcgatgacattgtcggacgttcgcgtacgaagaagatcgcgctggcgcgtcagatcgccatgtatttggtgcgtgagctcaccagcatgagcctgaacgacatcggccaggtgtttggcggcaaggaccacaccacggtgatgcatgcatacacccgcatcagcgacgagatgcaggaaaagcaggagatctacaactacgtgacggaactgaccctgcagctcaagcagcgttccggcgaaaaataacgttttctatgcgactttgcgcgtttgcatgtgttttcgtgcgtctcaaaaaacgattttaggcgttttctgcctttctcaggcgattttcacaagccaagtatgagtatcagtaaattctttatcagctgttttaccgaccatcctgacacgccggcctgtggaagatttttattgaagttatccacatggttatacacaaatcaatgatttctcggtggaaaacccgttggaaacgccagaatcgccggtggatgaattgtggactatccacatggttttgtggataactttttcaaagcgacgaggctgtggataacccgatgatttgtccacacttcgtccaaaagttatccacaagcaatgagatgtcgcgagccattgcaaaacgtggggtctgagcacttacccacattatccacaggccttattatgacgaatgtaggttgttataagaaattcatcatcgtcgtcataagtggggaattccccacgcttcgtcaaacgccgacagtctcgctagaatgacttatggaccgaacgaaacgaggaaactagccatgaaagttgaagtcaattcccaagcgctggcagacgcagtagcctggaccactcgcgtgatcgacgctcgtcctgcatcccccattttggcaggcattcgcttggaggccatcgacggcaccctccagctttccgccttcaattacgccatttccgcacgccaccatatcgaagcaggcgttgatgaaagcggatccattctggtgctcggcaagctgctggcagatatcaccaagtcgcttcccgccgcgaaaacctacctgtccactgacggatccacactgaccatcacgtcgggcaagtctaccttcaccatgcagctcatgccggataacgagtatccggatctgccggtggttcccgccaaactggggcaggtggacgcccaaaccttcgcacaggccgtcgcccaggcgtccgtcgccgtttcccgcgaggagaaccgtccggtactgaccggcattcgtgtgcagttccaaggcaacaaggtgatcatgagctccaccgaccgattccgcttgtcgcgttcgagcttcacctggacgccggaaaacccggacatcaacaccaccgcactcgtgcgcggcgcactgttgcgcgatgtggcccgttccttggacgagcatcaaaacatcgtcgtggatttcgatccggagaatccgtcgctgctgggctttgagaacgccggacgcgtatccacctcgcagctgatcgacggcgaattccccgcggtggaccgcctgtacgctgacgaatacccgattcatgcggtcatcaacaagcaggatctcatcagcgccatcaagcgcgtgtccctcgtggccgaacgcaacgctccgatccgcatggccttcaccagccaggaactcacgctgaccgcaggctcggtggatgaagcccaagccaaggagatcctcgacatcgacatggatggcgaagacatcaccgtggccttcaatcccgcctacctgatcgaaggcctgagcgccatcagcgagccgttcgtacgcatgaagatgaccaccgcggtcaagccggtggaattcaacggccagcaggaatcgaattccgaagaatccatggactaccgctacctgctcgtgccgatgcgcttcaacagctgaactaagctgacctacacgaaaacgcggatacatcgcaaaaaatagggctgaacatggctgttattgccagttcagcccatttgcatgattaattgcgattatttacgtaagaaattcgcactatctcaaggatcttgcatgtatatttcccgactggcactcgaccactaccgatcgtgggaacattgcgtgctcgatttcaaaccgggaatcaacattctgcaaggtgccaacggactcggcaaaaccaatatcgtggaagccatcgaagtgctttccacaggatccagccatcgcgcgtcatcatcactgccattaatcgaaaaagggtgcacgtcggccaccatccgagccaacgtggaagacggtgaaacgcagcacacctacgaggcgaccatcgtggcacggggtgctaaccgagcgcgcatcgacggcggaaaatctcaatatatgagggatctcatcgggcgcacgccctccgtctcctttacccccgaagatcaacgtctggtagcaggggatcccgcaacccgacgcaacttcatcaaccaggccgcgtctctgctgctcccccactatgcgcagaccctgcaacagttcacgcacgtggcgaaacagcgcacggcactgctcaaacaactcggcgacggcacgaatctcgacccgcaatacggccagcaggcggtcttaagcgggctggaaatctggacggggcaattcatcgacctcggcatgcagctgacgcgggaccgcaacaacgtgatctcacgcttggaagagccttttgcgcggatctacgcgtctttggcgggagatgacgaacgggcggcgctcgcctacgagccgtccttcgacgaagtgatgctgttcgacgatccggccgcggagatcagccgccatttccaacgcatctaccccggcgaagtggcgcgcgggcagaatctgatcggtccgcatcgcgacgacctgactttgctgctcaacgatatgaacgcacgcgaattcgcgtccaacggtgagatgtggaccatggctttggcgttgaaaatggcgctatacgaggcggtttccgcacattttgaaagcaagccaatcgtgattctcgatgatgtgttcgcacagcttgacgaggcccgtcgtgggcagatcctcgattttgcgatgcggcaggaccaggtgctgatcaccgtcgccgcggcaagcgatattccgcgcatggatgctgggcgctttcacgcggacgcgcatgtgatcgacgtggccgcgttgcgcaggcaatcgcaagatggacagcatgacgatttgacggcgatgatggcgcaacttgtcgcgggacgggaatctgcaacgcaatcgtctgcagcgcaacagtcggtgaatcgacaggagcagcgctgatgccgaatcctccaatctgcgaaacattgcatctcgaccaacgcaagttgcccgccgaagtattcgaacgtatcagccgacgtgccggccgatataaggaacgtgaggaacgtgcgcggcaggcgtgggagaatttcggcaaacccggacgcgacccgcagacggtcggcaatattttcaacgtgatcgcaacgcaaggttcttggacgccgcatctgaaaatcgcgcagatgcagaatcattgggatcaggtggtcggcgtcgaaaacgcgcgccactcctaccccgtcgacctgcgcgacggcattctgacgatccgatgcgacagccccgcatggaccaccaccttgacgtacatgattccgctgctgaccgacaccattcgccgtaggctcgaggggctgaccatcaacgaggtgcgcgtcaccggcccgcaacaacagggattcagccgaggacgaatgacacgaaggccgcgatattagcgcgacaccacgtgctatcagacgttcgttgaaggcgcttcgtcgaagaattccccctgcgacgcttccaagcgggccgttcgcaacggtcgaatgttgttttccgaaagcgaaaaaacaggggtaaacggctggatttcaaggataaatgcctctggcgctctgtccccctccatgagtagaatatcaagcagtgtatgtaaacgcctagaaggggcctttatttgcgttctaggtggtatcacctgcgtgaatgaccctcattggcgggaaaaatgcaggaaggaatctctgtggcagaccttgatgcggattcgctgaacgaatcagctgaaaacacgcaggaagatcagatccagaacgatcagctcgaagatgcgcagctcgatgacaccttggctccggagcattacgacgcttccgatctgagggttctggaaggccttgaggcggtgcgaatccgcccgggcatgtacatcggctccactggcccccgaggcttgcaccacctggtgtacgagatcgtcgacaactccgtcgatgaggcgctggcaggctacgcttcgcacatcgaagtgacgattctgccggacggcggcgtgcgcgtggtggatgacggccgaggcattccggtcgacgaagtgccgggcgaaggcgtttccggcgtggaaaccgtgatgaccaagctgcatgccggcggcaagttcggtggcggcggctatgcggtttccggcggtctgcacggcgtgggcatctccgtggtgaacgcgctgtcgacccgcgtcgacatcgaagtgcgtcgacagggcttccactggacccagacctacatcgaccagaagccgaccgcacgtcttgccaagggcgagccgatgggcgaagacgagtccaccggcacttccgtgaccttctgggcagacggcgcgatcttcgaaaccaccacctacgatttcgagaccctgcgcaaccgcttccagcagatggcgttcctcaacaaggggctgaaactgtccctgaccgatttgcgcgaaccggatcaggccggagacgaagtcgcgggcgaaagcgacgacaatgccgaaccgaagcatcagacggtcacctaccaatacgacgacggcatcaaggattatgtcgattacttggtgaagtcccgcaaggcaacccccgtcgaaccggacgtgatcgatttcgaagcggaagacctgaaaatcggcatttccgcggaaatcgccatgcaatggaccaccgcatactccgaagcggtgcacaccttcgccaacaccatctccaccaccgaaggcggtacccacgaagaaggcttccgcgccgcgctgacctcgctcgtcaaccgttacgcacgtgaaaagaacatcctcaaagacaaggatgagaacctctccggcgacgacgtgcgcgaaggcctgaccgcagtggtgtcggtgaaactcaccaccccgcagttcgaaggccagaccaagaccaagctcggcaattccgaagcgaaaaccttcgtacagcgtgtgatgaccgacaagctcggcgactggttcgattcgcatcctagcgaggccaagaacatcatccagaaggccattgaagcctcccgtgcgcgtcttgcagccaagaaggcacgtgagaatacccgccgtaagtcaatcttcgaatctgcgggcatgccagacaaactgaaggattgccagtccaacaatcctgaagaatgcgaactgttcatcgtggagggcgactccgcaggcggctccgcaattcagggacgcaacccgatcacgcaggccatcctgccgttgcgaggcaaaatccttaacaccgagcgtgcaagcctcgaccgcatgatgaagtccgaaaccatcgaatcgctgatcaccgcggtcggcggcggctatggcgaggatttcgacctgaacaaagtccgctaccacaaggtcatcatcatggccgatgccgatgtggacggcgcgcatatcgcaaccctgaatctgacgctgttcttccgctacatgcgcccgatgatcaccgctggttacgtgtatgtggccatgccgccgctgtaccgactcaagtggaccaaaggcgcgcacgacttcgtgtacaccgacgccgaacgcgaccgcgtgctcgccgaaggcaagtccgccggccgtcagctgccgaagggcgaaggcatccagcgttacaagggtctgggtgaaatgagctaccaggaactgtgggaaaccaccatggatcctgaccaccgcattctgaagcaggtgcagatcgaagacgcggccgcagccgacgaaaccttctccatgctcatgggagacgaagtcgaacctcgccgtctgttcatccagcgcaacgcccgcaacgtcagctggatcgacgcgtagggatttcaaggacttcaggcaaggtttcataaggatttagaaggacttagaagttggcagacgaaaacaacagcaacgaagacggccagttcgtgcctgacggctccatggagccgttgagcccgcaggaggccgacaacaccgattacggcctgatggtgggcgaacgcatccagaagaaggatctgcagcaggaaatgcgcgattcctacctggcgtacgccatgtccgtgatcgtggaccgtgcgctcccggacgtgcgcgacggcatgaagccggtgcatcgccgtgtgatctacgcgatgtacgacggcggctaccgccccgaccgcggctactccaagtgcgcccgcgtggtcggcgaagtgatgggtaagtaccatccgcacggcgattccgcgatctacgacacgttggtgcgtatggcacagtcgtggtctatgcgctacacgctggtcgacggccagggcaacttcggctcccccggcgacgatccggccgcggcaatgcgttacactgaatgccgtatggctccgctcgccatggaaatggttcgcgacatcgacaaagacaccgtcgatttcctgccgaactacgatggcaagacacaggagccgaccgtgcttccggcacgattcccgaacctgttgtgcaacggttcgtccggtatcgccgtcggtatggccaccaacattcctccgcacaacatgcgcgaggtggccgaaggcgtgcattgggcgctcgaccacccggacgcaagccgcgaagagctgctcgaaaacctgatccgtatcatcaaggggccggacttccctactggcgcaacgattctcggacataagggcatcgaacaggcctaccgtaccggccgtggtctgatcaccatgcgcgcggtggtgaacaccgaagagatcaagggccgcatgtgcctcgtgatcaccgagctgccgtaccaggtgaaccctgaccgactggtcgtctccatccgcgaagcggtgcgcgacggcaagatccagggcatcgccgacatgcgcgacgaaacctccggtcgtaccggtcagcgtctcgtgctcgtgctcaagcgcgacgccgtgccgaaggtcgtgctcaacaacctgtacaagcactcccagctgcagcagaccttcggcgccaacatgctggcgctggtcgacggtgtgccacgcacgctgtctttggatgccttcatccgccattgggtgggccaccagctggaagtcatcgcacgccgtaccgcatacctcaagcgtgaggcggaggaacgcgaccacattctgcagggctatctgaaggccctcgacatgatcgacgaggtcatcgcgctcattcgtgcttccgaatccgcggaaaccgcgcgcacgggccttatggacctgctggacgtggatgaagtgcaggccgacgccattctggccatgcagctgcgccgactggccgcattggaacgtcagaagatcctcgacgagcacaacgaactgatgcgtcgcatcgccgactacaacgacattctcgccaagccagagcgccagcgcaagatcgtgggcgacgagcttgacgaaatcgtgtccaagtatggcgacgaacgtcgaaccaagatcctgccgtactccggcgaaatgaacgtcgaagatctgatcgcggaagaaaacgtggtcgtaaccgttacacactccggtttcatcaagcgcaccaaggccgacgaataccgtgcgcagcatcgcggcggcaagggcatcaagggcgccaagctgcgcgaggacgacgtggtggaccacttcttcctcaccagcacgcacaactggctgctgttcttcaccaacaaaggacgcgtgtaccgcctgaaggcgtacgagctgccggagggatcgcgcgattccaagggacagcatgtggccaacctgctgcagttcgggccggacgagacgatccagaccgtgctgtcgattccgaactacgaagtggccaagtatctggtgctcgccacccgttccggcaaggtcaagaagaccgcgctcgccgaatacgattccccgcgtcagggcggcctgatcgcagtgcgccttatgaccggcgagaacggcgagaacgccgacgagctgatcggtgccgcactgtgcaacgccgaggatgacatcattcttgtgtcgaagctgggcatgagcctgaagttccaggctaacgacgagcagctgcgcccgatgggccgtcagaccgcaggcgtgcagggcatgaagttccgcgaaggcgacgagctgctggccatggacgtggtctggggtgattccgacaaggatctgttcgtggtcaccaacgagggcttcgccaagcgcaccgccatcagcgaataccgtttgcaaggccgtaacggctttggcgtcaaggccgtgcagctcgccgaaggccgtggctccctcgtgggcgcggtgatcgttgaggaagatgaccagatcatggccatcatgaagtccggcaaggtcatccgttccaacgtcgacgaggtcaagcgcaccggccgcaccacccaaggtgtgacgttcgccaagccggacaagaacgacgagatcatctccatcgcacgcaacgaggagaaggatgacgaatccgcggaatctggcgaatctgcggaaaaaacggaatccgcggaatctgggacgaacgcaaccgtgaacgagggtgcttcggcatcgtctgaagccgctactgaagccaacgctggcaacggcgatggcgagaatgtagaggcatgaagacaagacaggcaatcgtctgcgaaaactggtagcctcagctaagaactgggcacaatcttgcaaggagcaacgatgagcgagaacatcgaaggacagcaaatgccggaggttgggcaggcaccgcgcgtggcacgttccgcttccagccagccgctgattggtgcggatcaggttcaggcgcacgagggtgcctcctccgcttccggcggtgtgaaggtccgtgagaagcgtcgcggcggcgctccgcgtgcacgccgtatgagcctgtctctgacgcgtatcgatgcatggtcggccgccaaggtggcgttcatgctttccatcgcgggaggcatcattcagattgtcgcggtggctttgctgtggggcatgctgaacgtggtcggcgtgttcgaccaagttacgcagattgtgtcttccactggcttggacgctggcggattcgacctgaccaacgtgttctcgttgggcactgtgctgagcgccgtcaccatcttctccattgtggaagtggtgctgatcaccgtgctcgtggtgattttcacgctgctgtacaacgtggtgagcaccctcgtcggtggcatccacgtcacgcttggagatgattaatagcgcagtgcgctattaatggcagcgagcggcgatagcgtccgcgagcgtcgcatgcaatgctgaaatagcgcagtgcgccgtcagtagcggcgatagcaaactcaaacgcaacaagacggtctgtgtcgtgattcccatcacgacacagaccgtcttcgtattttctagaccagtctgtctcttaccgtacgccaaatcctatctgcctctcccctgcctgcaatctgcccatatctttcagatataactgcaactagattgggtgcgctgaagtacgtgttgaaatacgaaaagagggcctgtctggaatgaaaccagacaggccctcaatgtatttcgatgagccagccgtattggctagattggctaaaacggctagatcagagcacgccctgggcgaccatggcgttggcgaccttcacgaagccggcagcgttggcgccgagcatcagatcaccctcgtggccgtattccttggcggcttccagagagttggcgacgatgttctccatgatggacttgagcttgccgtcaacctcttcaaaagtccaggaaaggcggtaggagttctgactcatctcaaggccggaaaccgccacgccacccgcgttcgcggccttggcggggccatagagcacgttgttggcctggtagacggcgattgcctccggagtggaaggcatgttggcgccttcgcacaccacggtgcagccgttggcgacgagagccttggcggattcctcgtcgatctcgttctgggtggcgcacggcagggcgatatcgcacggaacggtccacacgcccttgcagccctcgtgatattcggagcccggcacacgctcggcgtattccttgatgcggccgcggtggcccagcttgatgtccttgaccacgtcgagctgaatgccgttcggatcgtagatgtagccgttggaatcggaggcggtcacaaccttcgcgccgagggcctgagccttctcggtggcgaagatggccacgttgccggagccggagatgaccacggtcttgccttcgaaggaatcgttgcgcagcacgcgcattgcctcggcggtgtaatagcacaggccgtaaccggtggcttcggtacgagccagggagccgccgaattcgaggcccttgccggtcagcacgccggaatactcgtcgcggatgcgcttgtactggccgaacaggtagccgatctcgcggccgcccacgttgatatcaccggccgggacgtcggtgaactggccgatgtgacggcacagttccgtcatgaaggcctggcagaaacgcatgacttcggcgtcggacttgcccttcgggtcgaagtcggatccgcccttgccgccgcccatcggcaggctggtcagggagttcttcaggatctgctcgaagccgaggaacttgatgacgccttcgttcacgctcgggtggaagcgcagaccgcccttgtacgggccgatcgcggagttgaactggatgcggtaaccgcggttgacctgcaccttgccctcatcgtcggtccatgcgacgcggaacttcaccacgcgctccggctcgacgatgcgctcaagcacgcccgccttctcatattccggatgcttcgcaaccaccggctcgaggctttcgaaaacctctcgaacggcctgcaggaactccggctggtcgccgtcgcgcttttccacctgcgcgtacacgcgcttgacgtactcgtcagtgagcatattcttccccttcgggatagttgggttaccaatagacggtctcattctatgtgcacgaatatggacggcacaagaccttgttcaggatttggagacgctttttgcgagtgctggttctgaacctgcttctttttacgggattgccgtgccttgtgttgcctataggatggaaatgcggaaagcgtgggagagagtacgtccgcaataacatctcacgatctcacataatgggagaatcatcatgattgaaggatttaagaaattcattgcacgcggcaacatgatcgacatggcggtcggtgtcgtcatgggcggtgccgtcaccacagtggttaattctattgtcaacaatgtgattaatccgttcatcgccatgattttcggcaaaccgaatatggatggtctgctggcaatcacattcaataatgcgacggtttcgttcggcgcggtacttggcgcgatattgaatttcctgattatcgcggcggccgtgtatttctgcattctcgtgccgatcaacaaattccgtgacgtgaccgaggcgttgctcgccaaaaccaagcttgcggaagaacggagcaaagccgaggaggaagctgccaaagagccggaaatctccaccgaagagcagacgatcctgctgttgcagcaaatccgcgacgaacttgccaaacggaatgcacaggatgcgcagaacgtgccgaacgattccgacactgttgccggtgcagtcgcagtgcggtagtcatcgtcagcaatcggaagtatcgtcagcaattgtaataatcaataatccgaggccgtctcaagcagtgacgcaagccccgcctgagacggcctttcgcaatggtctttcagcgggatgattcttccatgcgctggaataatacggactctggaaggtgcctcagcgggtcatatgttccagtgactggagggatctggactgtgaggtgcttggctgcgtctagttttctccagtgactggaggttttgggatgctgggaggcttgttggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggattcctccactcggtggaggtttttggactgtgaggtgcttggctgcgtctagttttctccagtgactggaggttttgggatgctgggaggcttgttggtgggaggattcctccactcggtggaggtttttggactgtgaggtgcttggctgcgtctagttttctccagtgactggaggaattgggatgctggtttggatttcggatttgggtatgaaaaaagggtttccggaaatcaccggaaaccctatctgtggagctaaggggattcgaacccctgaccctctccatgccatggagatgcgctaccagctgcgccatagccccgtggagctagccgggttcgaaccggcgaccctctgcttgcaaagcagatgcgctaccagctgcgctatagccccatagttgaaaaaaagcggccgcgccgctcttaatcaccgtgggcccgggaggacttgaacctccgacctcatccttatcagggatgcgctctaaccacctgagctacgggcccgttcctgctgcactgttaagcacaacgaattgaaataatacgcgaatttcagagaaagtcaatacaaggtgtgtcttcggcgtgtcgtgacataatgcagacatgccgaacaatcatcgtagccagcgtaacaacagtgggagagccagcaggggagtgcgcagccgtaatcgcacgctatccgaagaaaccacgcaaatcgctggaatgacggtgaccatcgtgcgtaaagccatcaaaaacatgtacctgcgcatcaaaccgccgaacgcgcaaatcgtcatctccgcaccttctcgcatgtcgcaagcggcaatcgcacgatttgtgacggaacgcaaaccatggatcgaacgtgcgcgacgcaccatgctgcaagccaaggatgaacagatccgtcaaagcgatttcaatggtttggaccgtgtgaatggttcgcatggtccggataatctgaatggcctggaaaattcgggcggcgtgggcgatcgaaacaatccaggcgatcccaatagcttgaataatccgcgcgttttcgtgtggaacgacgcggcgaaggaacgggccgtacgggccatcaatgcgcaactgccggtgctgcttgcgaaatggtcgccgattatcgggcggaagccgacgcatgtcacgttacgcatcatgacgtcgcgatgggggtcatgcacgccgaaaaccggccgcatccgactcaacctgcaacttggtcttatggatcccagattcctggaatacgtgcttgtgcacgaaatgacgcacctgtgggaaaacgggcacggagaggactttcagcggcgtatgagcgcatatttgccgcaatggaggcaattgcggcgggagctgaaccgtcatgttgtgttgtgatgctcgcgatgctgttgcgttcgccgtcacgctgccatgctgcgatgagcttgcgtagggcgatgttgttgcgttgcctgtgatgttgaaatacttgcgatatcacgccactgccgtcacattgcgcggattgcaatgactagccacggcttacgcacgtttgataacgacgtataggtgattcgtatagctttttgttcataagatgtacagaacgcttaacatccgcgatttgcaagcctacaatcgtgacgactgaaacgtttgcgtgcaaacagtccacgcagaaagatcgaataagtgagggaggggtcgattgtgactgtattgagaaaagtcggcattatcggcatcggacacgtgggcgcgcatgtcgcaaatgccgtgctttccgcaggactggccgaagaactgaagctgtgcgacatcaacgagcaaaaagtagtcagcgaatgtcaggatttaagtgacacgttgggtttctatccgcataactgcgtgatcggcaactacggcacgcaatacgagcagctagccgactgcgacgtggtaatcaacgctgccggcgacgtgaaaaccagcgccaaagatcgtgacggcgaactgttcgtcaccaccgacattgcacgcacctggatctcccgactgttcaacgcaggcttccacggtgtgatcatcaccatctcaaatccgtgcgatgtggtcgcaaccgaaatctggcacatcaccggctacgatccgcgcaaaatcatcggaacgggaaccgcgttggattccgcacgactgcgcaacgccatcgcgaaacgcgtcaacgtggatcagagatcaatcggcgcatacatgctgggggagcatggcaattcgcagttcgcctattggtcgaacgtgaacatcgcaggcaagccgcttgatcaactcgcacaagacgatccgcagcgattcgccctcgacaaggacgaaaccgagcaggacgcccgtcgaggcggataccgcgtgtacgccggcaaagagtgcacggaatacgctattgcagccactgcggcacgccttacgcaggctgtgctctgcgatgaacactatgcgaccgcctgctccacgctgcttaccggcgaacaaggcgaaagcggcaattacgccagcctgccgtgcatcatcggagcgaacggcgttgaagaagtcctcagtcccacactcaccgaaagcgaacaggccaaattccatgcgtcctgcgagcatatccgcgccaatatcgcgcagcttgcatggtggaacgacgaatgccatcccatgctgcgcggctgaatctgcaataactcagcggatttaataacagagcagacttgcgattactgatgttgattgtgtaaaaaatcagcatttacataatcgcaagtctgttttattttcattttattttcgttttatttttgattatttcgtagctttcgcagcatcgccgtcaacagtatgcttgcggatttccaacgtttcgatacgacggccatccacttgcgtgacggtcatgtcataaccgtcgtcggaaggtagcacgtcgccgatttcgcccatctttccagtatgcgccaggaaatagccggcaaccgtctcgtacggaccgtcttccagctcaataccggtcaaatcggcgaaatcctcaatcgtcatgccgccttcgatcgtggcgacgccattgacgaacgtggtacgttccgtgcgttcgccgcctttctcttccggcagatcatattcgtcgcgaatatcgccgaccagttcctccgtcatatcttccaacgtgacgatgccgtcggtaccgccatattcgtcgatgaccaccgccagatgaatgccgcgcttacgtagcagctcaaggcttggcagcagtttcgacgtgcccggcagcgaaatgccctcgcgcgtcacgtcggcaacggttctcgccttcggatcgcgaatgtcaagcaggtcgcgcacatgcacgaaaccaagcacatcgtcgaaatccttgccggtcaccggatagcgggaatacggcatttctctcacatatgcggccgccttctcaatcggcatatcgccatccaaaaaaaccacgtcggcacgcgggcgcatcacttcggccacaatcgtttcggacgcgtcgaacacgtcgtcgagaatcgtgcgttcgtccttgctcaagttcgtattggtgttgacgagtacgcgcagctcttcgtcggacacttcgctgtcggtttcgttcgggtcgaaaccaagcaagcgcacgataatgttcgtgttcttgccgatcagccaaataatcggcttgcacaccttcgcaaacacatgaatcgcaggtaccacggcacgcgcgatctgctcgttgcgttgcatggcgatacgcttcggcaccaactccgaaatcacgatcgaacagtacgaaatgatcaacgtcagcacaatggtggtcaggggagcggccacactcgtcggcacgccccaactttcaacgatcggcacaatataaggcgaaatcgacgattcgccgaacgatgcggaaaggaaaccgctcaacgtcacgccgatctgtacggtcgacaaaaacgtgttcggatctcgcgcgatctgtgcgacgcgctttccgcgggcatcctcctgttccatctggtcgatctgcgatccacgcaggctgaccaacgccagttcggtgccggcgaacaccgatccgagcaacagaaaaacgaaaatcagaagaatgttcaaacctagagacatggttccactctatcggggcggtatgtcaaagtgtctgtatctcctgattttcttggattttctcaattattcttagattgcttagcttcggattgttcttttttggatctctgtttcgcaaatctccgttttccgaattgtaatccgtttcagaagctaagaacctcgactttgccggagtccagctggtaccttgcgccgacgatcatgagtttgtcggatgccagcgcctgctggatcgcttcggattgttccaccaagagttcgatggtgcgcgcgatgtgcacgcgttcgaaatcctcgctggattccaattccgactcgtgcgcctgccagattgagaaaccgacggtgcgcatcatgagtgaatccgaagcgcagatgcgttcgtcgatgtcggcaatgctgtcggcggccatcagcgaatcctcggcatcggcggtcagttcgtgcagtaacgcctcgtaatccttggaagcttgcttgatcgcaccgcaattctggtggccgagcaccaccagcaaacgtacgccgagcacggtcaccgcgtattccagggacgcaagcacggcttcgtcgatgatttgaccggccgtgcgaaccgtgaacaggtcgccaagaccggaatcgaaaataatatccgggcttacccgagcgtcggagcagctcagtacggccgcttccggtgcgtgtgtgtccacaagtgctgcgcgtgcttcggcgccacgattcggatgttccggtttgccttccgcaaacctgcgattgcctgccagcatgcggctccatgcgccgcttgccgtaccttcgacctcgttctggtctacaaacagttcgtctgccattgactccacccttcattgttcaggctagccaacatcatacgttttggtctgaccgttcgctgggaaataaagcgatatctcgcttatgtatggcagatttcgtgttctgtccggtgatatttcgcttatgtatggcagtcccaaaggtgaaaaaccggaaaaatgtacccccgaagtgggtttttcgcatgatggtctgccatatataagcgagaaggctcatgacaaggctccgattctgccatatataaggcagatataggtatgaaaaagggtccccgatcggcagtgcgaacggggaccctgaaagaaactggctacaatcagccggtgttctgcaggcctgctgcgacaccggacacggtgcacaggatcaggtaggtgttactgcagtctgcagaagatgaaaagaataagagctaaaacaagaaaggcggcaccgcttattctcattaaggatgtgtatagattgctcggatctcctttttgagtccagaggaaattgcttattttccagagttgccttggaaaaataagcatacataatcctagcagggcaagtgctgtgagatgtatgtactgcactgttctccttattttaggtagtcggagatgcaagggtatggtccttgtttatttattccgttgcttgaatctttgaagaaatcgatactctcaaatgtaatccctttatattgcttcacggtaattactttaaaatgaaggttaattctgtcttctttcttgtacttgttggtgatattttcattaaatttccattcaatatattcgttgtctaataaaaagaagagtgatgtattgttttcatcgagcgtcccatgttccggtgccatcgctgcttgatctggtgtatgagacatactggtttgtccctactgttttattgataacccttttgcctgaggttgtggacaaggctagaactatattggctccaaaatcgacggggttagctctatgcgcgtgcatttcgaaactggtcacacggctggagacttgagggcgcatatagaattcgcccccattggtgccattgttgaaaacaatggaaggtgaaaccatataggtggaatattgatcatttgaactttgcccatcgagattgactacccggtcgatgacgttattggcgacaatccatccaacctgccaccaatttacagcaaaggctggagtggtcataactgtgcataggcaaactgagataattgtggagataaaaaaactcttctggatttcataatttcctccatgtgaaaatttaatctcaatcgacaatgattaagatattaagagtattctaatggaaaatgagtaggggtgcactttaggatgtgattttctagtgaaaatagcaaaggttctctctcgtggaagttacaaacgagggcttcgctatgtgtctgtgtttcaggagtcatgcagttgttactgaatcatgagtggattgaggataagtatgctagtgctgcatgttaggcgctgaacaaaaaccttcgagtgcggcgtcttccgtcaacaacacaactcgttcagaaatacacccaatatggtcaaacagtaagacagcgctatgatgcgaacaatcttcttccaagacagtttgtcatgaaggaaagccgtaaccaaaagggttgtcattggggttataagcaggacgaggaagaaatagagaaatgtggactaggctcaatctgccgagaatataagtctgaccgaaccagttgtataagcccacgatggctgtcggtgtcgcggcgtgggtaaacgcggacaggcgccgggttacgtcggatgattgggagtctgtcgctcggcctgcgtgcctgttttgtgcgctgtcgccggccaggctagggccgcgcgacgcgaacggggaggcccgcgccgtttatcggcacgggcctccccgttcgcttttgtcaggcggtcagccgaagatcagcccgtgttctgcaggcctgctgcgacacccgacacggtgcacaggatcaggtaggtgtagttctccttctgtccgtgcgtgagctcttccttgtccacgcgcttgcgtagcgagccgagggcgagcacctgagtggcggacagcgcatccacgtacggcgagcggatgcggatggcctggccgagcacgtggcggtgctgcagaggccacttgtcgcctacgatctcgagcacccacttgcgggtgagctccatctcgtcgaggaccttcttgttgaggtcttcacggtctccgagggcaaggtacatcttggcgatgcgctcgtcagtcttggccagcgacatttcgatgttgtcgatgaacgtggagaacagaggccattcctcatacgcttgacgcaaggtgttcaaatcgccgaactgttcgcacgcggtgcccaggccgtaccatgcggccagattgatgcgtgcctgcgcccaggagaagatccacggaatggtacgcagatcgtcgagggacttggctccaaggccacgtttggccggacgggagccgatcggcagcaggccgatttcggtcagcggcgtgacggtggagaaccacggtgcgaagccgtcggtgttcagcaggtcgaggaagcggttatgcgcggcctcgtcgagcttgttggccatgtcggcgtacttggcggtcatgtccgtattgcgcttctccacgcttggagcggactgcagcagcgttgcagccgcaacggactcgacgtggcggatggccagtgccgggttgccgtagcgtgcgaagatgacctcgccctgctcagtgagcttgaagcggcactttacggagccgaccggctgtgcgagtacggcacggttagccgggccgccgccgcggccgacggcaccaccgcggccatggaacagggtcagatcgatgtcatgcgattccgcccacttggcgatgcgttcctgtgcggaatgcagggccagggttgcggaggtcgggccggcgtccttcgaggagtcggagtagccgagcatgacttccatcttgccgccggtggccttcagacgagcctggacctccggaatcttgatcatttcctcgagtacgtctaccgagttctgcagatcctcaagctgttcgaacagcgggatcacgtcgatggttggaacatccttgggatgggagaacgccagacggttcagctcgtacacgtccctgatgttttgggcgctcttggtgaaggagatgatgtaacgacgggcggccttgatgccgttgcgcttctggatggaaccaagggcgcggaaggtgtcgagcacctcgtgggtcatcggctgcagttcgccacgctcaccgtgcagaccatgttcgcggatatcctccagcgctcgggaatgcacgacggagtgctggcggaactccatctcgaccatatggaagccaaaggtctctgcctgccagatgaggtcctgcagcgggccgtaggcggaacgtttggcgttggcttcggcgagggagcgctgcacggtcttcaggtcggcgatgtaatcctcgcaggagtggtacatgagatcagcatcgcggtcgatggtggccttcagacgatcggccatgaccagcatgacggcacggtgcagctccttggtggagatcagtgcggccttgtcggtcaggcgctcgctcatttccttctgatggttccacaggctcttgagctcggcactcggcggagtggtctcagcttccatcgtcaggttcttgccaacgcggcgggtctcgatttgcaacgcgcccagcacgtggtcgctgaacttgcgggccacctgacggctcaccttggcggtgacattcgggttgccgtcacggtcggagccgatccagcttcccgggtggaagaacgccgggcataccggcggcacgaggccagccttatctccgaggatccaatcgtcgaaacgacggtacacctgtggaatggtatagaacaacgtattgtcgaaaatatcgagaatggtttcagattcctcaaccggagtcggcttcttcagtgcgatcggagaggtgcggaacagcgcgtcaatctcgttgaagagtcgacgggagttttccttcttgtctgaaccgccaagcagcttgtgcgttgcgagcagctgggagatgcgacggattttgccttccacggctttgcggcgggcttcagtcggatgcgcggtgaacaccggatggaactcgagctggtcgagcagttccttggctttggccggacccatttcgttaatgagctggtggtaggcgcaggtcatttcgttcactgggtcgacggcttgggtgtcatctacggcggcctcacggctgtgcagcacggagacacggtagttctcctcgcataggttggccagatggaagtaggtggtgaaggcgcgggccagcagttgtgcctcatgcacatccgttttatcgatgatgtcgacgaccttctgcagatcatcctgattcggattcgtatccgtcagaatgccggagaaacgttcggcgctagcgttcagtgcgtgttcgcgcacttcatcgaacttggccagcagcttttcatcgaattcgccgagcacctcgcgaagaatctgcaaacacagatccatttcctctttgagggaagcgggaagatcacgctcctcggggcctttggtgccggtgccggacgagacgatagctgcgtcggcaggcgtgatctgttcgttttctattgtcatcagacctccttctccaaaccatcgggttgcccggtctgtcggtccttcgcggcacctccgcgattgttttggccgtctgttgcgagcccacagccctaagttcggtcggtaatgcacgaccattgtatgcgcggcaaatcgacagtttggttacggaaataccggaaatgtccgcatcgtggtccagtggtgtccacaaggtgaaatcgacggaaatttcgaaaatcctccgaccagcccacacgttagacctgaacttgtgagcgcacaatacgaacatgaacatgagacgaatttcgatagcgcggaaaaaagcgcttcggccgtcagcaaattccatacacactccattccgctcgatatggaagatatcgaacgggattgggacaagccggtcgctgaagcgggaatcgcagcaaaagccagcgtgatcgtacgcgtcggcatgctcgatctcggcgcgggcaccggaagcttccgcgtacgcgaaatgatgcaccgcatcgcctatccgctaggcgtgcacgtgcgcgccgacgtgaacctcaccgacatcgaagcctcctgcaccgacggcaaagaccgtatcaccgaagtcgtcgacctgccaaccaccggcgtcaacacggaatgcatttggctgctcgaacacttcgctgactggttcaacgtgaacctcggcaaaggatcgatgtaccacagccaatccgacgtgtccgaagggcttatgcagcatctcgacaagcgtgatgcgtcgcaggtgtcggctgacctgtcgaagcgtcttcgcgaacgtcagaaagccgaacagaatcaggagggatctgatgatcccgtgctcgacgcgcttgaaatggtgacggaacgcgccgaagtgaccgataccaccgcgcagccgttgcacttgcgtgacatcgaagcggcaagcgagcagcataatcgcggtgaacgtgaagccgaacgtgaaaccaagcgtgaaactgccggtacggccaacgttacgtcaagcgaatcgaccacgaaaaaagcgcgcaaaaatcgcaatcacaagccgccaaaaggtcaatacgccgaacatttcgaccacgtcggaaaagaagcggaccaatcgcaaggcatcaccgttcgccaagcccacgaacgactcgacatgatcgaacgacgcaaacccctgtattcgccggcgttcgcgggattcgcctcggcctgcgcctgcgcatccttcgtgttcctgcttggtggcggtcccttcgacatgatcggcgcgttcatcggcgcgggacttggccactggctgcgccgccgcctgttcgcccaccatctcaaccagttcttcgtgacgttcgtatgcgtggcagtcgcggcactcgcctgcacgggcaccctgcgattgattggtattttcgagcccgtcgcattgcagcatgatacggcttacatcggtgccatgctgtttgtgattcctggattcccgctgattacgggtggacttgatatggcgaaaattgattttccgtcaggtattcagcgcgttgcgtacgtgttgtgcattattttgatggcgacgctcgcaggctggatggtcgcttcgatcgtgcatttgaatccggaaggattcgagccgttgggactcaatccggttgtcaattgcctgttgcgtttcgtgttcgcattcatcggcgtctggggcttctccaccatgttcaactcgccgcagcgcatgtgccttgtcgccgccaccattggcgccattactgacaccttgcgtttggaaatcgttgacatgggcgttcccgccgaagccggcgcattcatcggcgcactgctcgcaggcctgcttgcctccgcatggcgttctgcggttcatcgcagctggctcgccccgcatctcggctacccgcgcatctgcctgaccgtgccgtccatcgtgatcatggttcccggtttgtacatgtatcaagccatgttccacctcggccaattcgacaccttgaacgccctcgactgggctttccgcgcgttcatggtgattatctgtctgccgatcggcctagccatggctcgcgttatcaccgataagtcttggagatacgatatttgatccgtttcggcatttgggcgcgtaaatgagataaatgcgattgtcgcaatgttcgaccggtacattgggacaatcgcatatttttttcagaagagattcgaaagaaattcgtttcgacagagatttgaagaaagagattcgaaagaaattcggctagcaatctaagaagagagaattcatggttaccaaagatttttgggtgctgctggcgatggtcatctattttgtggccatgctcaccatcggcttcatctactccaagcggtccaattcctccactcgtcagtatttcgcgggtggtcgaggcgttggtccatggctgacggcattgagcgccgaagcctccgatatgagcggctggctgctcatgggactgccgggcgtcgcctacttcaccggtgccgccgacccgctgtggacggccctcggcctggctctcggcacctacctcaactggaagctcgtcgcacgccgtttgcgccgctactccgtggtggcaggtgacgcgatcaccattccggacttcttctccaaacgattccatgacaaacgcaatatcgtctccaccatcgcggcgctgatcatcctcgtatttttctgtgtgtatgtcggtagctgcttcgtgacggtcggcaaacttttctcgaccctgttcggctgggactaccacctgaccatggtgatcggcgctgccatcgtgttcgcctacaccgtgatcggaggctatctttccgtggtcgtgaccgacttcatccaaggcttgctcatgttcttcgcgctggcagtggtgttcatcggttccgtcgcatccgtcggcggcgtcgacaacaccgtcgccttcctcaaaggcattccaggcttccttgacggcacgcaaatggccacgccgattctgaacgatgccggcgagcagattgtcaaggctggccaggccatgttcggcgcgcctaccgaatacggcgtgatcaccatgatttccatgcttgcgtggggtcttggctatttcggcatgccgcaggtgctggtgcgattcctgtcgatccgcagttccgaagagatcaagaagtcccgtatcatcgccaccacgtggtgtgtggtgtcgctggcgtgcggcgtgtgcatcggtttggtcggccgtgcgatgatgccgacgcagttcgtcacgcagtccgcggcggagaacattttcatcgtggtttcgcaggcgctgctgccgagcttcatgtgcggcatcgtggtgtcgggcattttcgccgcgtccatgagctcgtcgtcgtcatacctgattatcggcgcttccgcggtcggtgagaatattttccgcggattgctctatcgcaaggccaccgatcgtcaggtgatgatggttgcgcgcatcacattgctggttatgttcattttcggcattgtggttgcgttcgatcagaattcgtcgattttccaggttgtttcgtatgcatgggccggtttgggcgcttcgttcggtccgctgatgctctgctcgctgtattggcgtcgtaccaataaattcggtgcgattgcgggcatgctttccggtactgcgaccgtgctgatctggcataatttcatcaagccgcttggtggtgtcttcgctatttacgagctgcttccggcgttcatcatctcgctgctgttcattgtggtggtgtcgctgctgactccggctcccgatgctgaagtgctgcacgagttcgatcattatcttgatgatcccgatgaccgcaaggtggatgacgatttggtcgcagcggaaatcgcttccggcgaaaagcgcgcgaaaatctaatcaaacataatgtggcacatgccactcagacgcaacaaaggccggattgcgcaatacgcaatccggcctttgtcgatgctgaaacgctgtttaaagcgtgattatggcgtttctggagctttagtagcgcatgcccatggcgtcgcgcacctgctccaacgtttcgttggcgatggcgttggccttcttgttgccttcggcgagcacgtcgcgcacgtaatccatatccttggcgagttcctcgcgacgggcgcgatgcggctcaaggaagctgttcaccgattcgatcacatacgccttcagcgcgcccgcaccggaatcgccgatctcctcggcgatctccttcggatcgcgaccggtgaccaaaccggcggtcgtcagcagtgcggaaacctgcggacgtgcgatcggatcgaacgtgatgcggcgctcggaatcggtcggactcttcttgatgagcttggcggtctcctgcgctgtggcgcccaacatgatggaattgccgtacgacttgctcatcttgcggccatccaagcctggaatctccggcgcttcagacagaatcgcggccggctcggggaacaccggatgcttcttggcgtagcgttcgttgaaacgacgcgcgatggtgcgcgtgatctcgacatgcggcaggttatccttgccgatcggcaccacattggccttgcagaacagaatgtcgcatgcctgatgcaccggataagtcagcagcaggccggtcagcgcatggccggaagcttccatttccgacttcaccgtaggattgcgatgcagctcggcctcagtcaccaatgacaggaacggcagcatcagctggttctccgcaggaacggcggaatgcgtgaaaatcatggtcttttccggatcgatgccggcagccatgtagtcaagcaccaaattgagcacattgtcttcgatatgctcggtcgtgtcacgatcggtgatcacctgataatcggcgatgatgatattcgaattcacgccgcgattctgcatggcgacgcgctcacgaatcgaaccaaaataatggccgagatgcagacgtccggtcggacggtcgccggtaagcatggtgaacttgcccggattctgttcgattgcggcgagcgttgcgtcggaacgcttcttcgctgcgaggaagctcgcgctcatttcattgccgacagcggtgatctgctgctcctgggtttcgtccgtcatacgtgtccttttcttaagaaaatcagcgattttatcgtaaaagtctgagccgacaacgaaatatggcataacaagtggtactctcttgtttgatgaattgatagcacagtaatcctcagggggtcagatgggccgcggacgtcagaaagccaaacagcagaaaatagcccgaaagctcaagtacctgaccaccgacaccgattatgatgagctcgccaaggagctcggtgcccaggagcctggttcgggttcttttgatcctttcgccgatatcgaagcaaaatattctcacgatgcggacgctgaagatgagattcctgaagatgctcaggagtccgcgcaaaccgacgccgaggatgacctcgacgagtatgcaaagtgggccgcagaggcggcggcgaaggccacgagcggagagttcccggcagccaagtccgccgcgccgaagccacacaagcccatcccgatgccgatgcccagcgcactgaagccgaagaagcaggactgatcggcatatcaggtactttgtgaaaccgcgatgtggatatgcctgctaggtgtatccacatcgcggttttgctatgcgtttttgcgcctgtgacggtcttctcgcagcctgtcacaccaacggcagcaagctactcaaatcgtcgcgttcgccaacggccgtgatgcgtcccgcctccttttcctcctgccagctggtgatgcccgtggcgagtctcatccacacgtctggttccagttcgatcacatccggcggtgtgagattatgcggatcggatgccggtccgtcgagaatcttgatggcaccccacggcgcgacacgaacttccacgcccgccccgggcgcttttttctccagcagatgcagcgagtagcgcaccgccatcgcccacagctggcgtggcaatcgtggagagaattccagacggaaatcgcgggccgcgtcggtatttgcgggaatattgtcggcgatcatgcgatgagacgtttgcagccattgtgcaaatgcgtcatgccccttatgcagatcttgttctcgaataacagccatacgtgttattttgccgtttgcgagcgactatgatggggtgttgcagacaacgtagtcacaactgaataggggtgtgaagagaggaaaatatttgcgattcttgatagcgttcgcaatgttgttgcatgttgctcgcaacgtttttgcagtcggtttgcattatttttgcaaacgaatgcttgcttgtaattgcttgaaatttcatctttttatgattacgtagtatgctgtgtatgagaacgtatgcatgatgttacttagtgttcatgcggccgctaatgcaaggacgctggggtaaggcataatgttcctggagagtaatccgtcaaagggagtcgattaatgactgaaattaccgcaccgaagtccgcggtcaccgcggagcagttcgcagacgagatccgcgagcagctgaagtacacccagggcgtcaccgtcgagcaggccaagccggccgacgtgtacgtcgccgcgtccgccgcagtgcgccgccacctcatggattcctggttcaagacccagtccgacatggtcaacggcaacaccaaggcagtcggctacctgtccgcagaattcctgatgggcaagcagctgcgcaacgcgctgctcaacgccggtctgaccgagcagttcgacgccgcggtcaaggaactcggcttctctgtgcaggacgtcgtcgacgccgagcacgagccaggcctcggcaacggtggcctcggccgtctggctgcctgcttcatcgattcgctcgcctcgctgggcgtgccggcattcggttatggcattcagtacaagtacggcatcttcgagcagaagttcgatgaaaacggcaagcagatcgaaaccccggactactggctgaccaatgaagagccgtggggacacatcgattacaaccgcgaccagaaggtttccttcggcggcgaagtcgttgaggaagatggcaagaaggtatggaagccggcttggtccgtgcgtgcggtgccggtcgactacatggttccgggctacgcctccggccgtgtgaacactctgcgtctgtggaccgccaagagctacgacgagttcgacctgctcaccttcaacaagtccgagtaccttgacgccgtcaagccgcaggttgaagctgagaacatctccaagatcctgtatccggaagattccaccccgcagggcaaggcactgcgtctcgagcagcagtacttcttcgtgtccgcctccatccacgacgccatccgcgtcttctacccgggtcaggacaagccggatctgaccaccttcgcggacaagatcaccttccagctcaacgacacccacccggtcatcggcattccggagctcatgcgcgtcctcatggacgagtacggctacgattgggacaccgcctggaccgtcaccaacaagaccttcaactacacctgccacaccctgcttccggaagccctggaagtgtggccgtccaagctcatcggcgaactcctgccgcgtcacctcgaaatcatcgagaagatccaggaccagttcgcagccgagctcaaggccaagggcgtcgacgaagccaccatcaaggacatggccatctacaccggcgactccgtgcgcatggcctacctggccacctacggcggctcccacgtcaacggcgttgccgagctgcactcccagctgctcaaggacgtcaccctgaagaacttctccgacgtgtatccggacaagttcaccaacgtgaccaacggcgtgacccctcgccgcttcgtcaagctcgccaacccgcgtctgtccgacctcatcaccgaaggcctcggcaccgacaagtgggtgagcgacctcgaactgctcaagggcctcgaaccgctcgcagccgatgacgaattcgtcaagaagttcgccgccgtcaagcaggccaacaaggttgacttctccaactacgccaagcgcgaatacggcttcgacatcgacccgaacaccatgatcaacaccatggtcaagcgtctgcacgaatacaagcgtcaggcactgaagatcctcgccgtgatcgcacgctacgccgacatcaagtccggcaaggtcgccgccgacgatgtcatgccgcgcaccatcgtgttcggcgccaaggccgctccgggctactacctcgccaagcagaccatccagctgatcaacaacgtcgcccgcgtcatcaacaacgacccggacgtcaagggcaagctgaacgtctacttcccgtggaactacaacgtgcgtctcgcacagcacctcatcccggcaaccgacctcgacgagcagatctcccaggccggcaaggaagcctccggtaccggcaacatgaagttcgctctcaacggcgccatgaccgtcggcaccctcgacggtgccaacgtcgaaatccgtgagcgcgtcggcgctgagaacttcttcctcttcggcatgaccgtcgacgaggtggacgccctctatgccgaaggctacgatccgaagaagtactacgaggccgatcctcgtctcaaagccgccatcgacatggtcgcggacggcaccttctccaacggcgacaagaccgtgtacgaagaccttgtccacgattggctcaccaaggactggttcatgaccctcgccgacttcggcgcctacaccgccatccagtcggaaatcgaggccctctacgcccagccgctcgaatggaaccgcaaggccctcatcaacgtggcgaactcgggctacttcagctccgaccgctcgatggaggattacctcgagcgtatctggatgaccggtccgctcaagtaatgacggagcgttatctgcgttgtggaaggcttgacgtatcttcgtacgctttcgccttccacgccttgtgatactgcgctcgtcattactttcgcttcgcacgggccatatgtgacgtgaattatcgcgtgatgtatgactcgtagcgttagatagggcgtgatgacgaagggacgattccgttttggaatcgtcccttttcgttttctcaggcaaaacaaaaagccctgcgcgtggggcgcagggcttgaaagaaagagaaatcaggcagcttctggggtggcgggagcgacttcggcttcgccatcctcggcatccttggtcaggccgagatcgacaggagacgagctgttctcccatggctcctcccacggatcgtaatccggattctgctgcttgtacacatacagaccgacgacaccggcaagcaaagctccgaagagcagtgcgaagaacttccaaccgttagaagacttgttctccatgacggatcctttcccaaatatcggcgaacattggctgacctgctcgttcaagccaactctgttcactatattaattccttgaatgtgttgattgggtggatttacgcgccggggattcacaagaatgcaatcatttgcaatgatttcgcagattcgcggattcgcacgttccagtagggttgaaacatggcttatcaacgtttcagtctgtttcccgattccccgtcgttcaaagacttcttctctgcacgttccatgcgataccgttggcgtaacggcgatcctgtgatcaccgttacgatcatggcgatatgcgtcgcggtctggattgtcgaaacactattgaaaatcgtctggccgaccggctgcaacgcattcgtcggctcaggcgtattcatgcccgcgctggcgactcaccgcccatggaccttcattacgtcaatgttcctgcaccagccggcctccctatggcacattcttttcaacatgctgaccttgtggtgcgtcgggcctgtattggaacgcatgatggggcatctgccatatctcgcgttatacgtgctggcaggactcggcggaagcgccggcatgatggtctgggcactgttctcgcaagacggttggctgacatccgcatacggcgcttccggcgcgctatttggcctgttcgcggcaattctggtggtataccagcgcattggcatcgacattcgatccatgctgatctggatgctcatcaacttcctgatgccaatcatcacgccgaacatcgcatggcaggcgcatatcggcggattcatcgtcggaggtgcgttcgcctggctgctggtttccggcctgcatgcgttgcgcggcaaaagcctgcagcagcgcacgctgatgtacggcgtaatcatgttggccgtgattattgcgattgtcgtcgcatgcaatatgagcaatccacttcgcgcaaacccccttcttggcatgttcttctagtcgttaggtgggagaaaaacagatttgggggaattgtacgcatgcacttatccacatttgtggataagtttgtggataagtgagggatgagctgtgggtaagtcggggataactcggtgcattatccacaaggatattcacaaaacggtggattccccggcttttcaacggtggaaaatgtggataacccgactgtgcatagtggaaaaatgggaaaaacaccatcctatatattgtggacggtcataaaactgcctacaagatatagacgctatccacattcgtccacaataatccacgacttatccacatcgtgtgaaaccagaaaatccccagaatgacgacgaatcaacacaacgaaatcaggtacgtcaccaatgacaatcatgaatgacgagacgcgcgaattcgtggcgatgcatcgcaacgaggatgtgcgcgaactggcgttgaaggccaaacgtgtggaagggctcgacctgccgttggcgctcgaccagattgccggatggcagatcgcacgcaaaaaactgccacaatgggcttcctgcgagggaatcgtatacccgccgcacatttccatggaacagtgctcatcgcagttcacagcccaatacaagtcagaaatcgcacaaaccctgctcgcgccggccgcaaccgtgcgcgccagagtgtccgattctggagaatcggacaaccaaaccacgaaaagtgagccacagttgtccgattccgccgaatcggtcatgcaaacggcaaaaagtgcgttccagttgtccgattctccagaatcggacacgcaagagatgaaaatgggcgcgtggatgtccgattcgccagaatcggacacattggtggcgagaagttcgatggtggatctgacgggcggattcggcgtggacttttcgtatctggcgcgcggattcagccaagccacttatgtggaacggcagcggcatctgtgcgatctggccgaacacaatatggccgcactgggactcgaccaggcgcgtatcgtgtgcggcgacggcgtggaatacctcaggcagatgggtccggtggacttcatctaccttgatccggcccgccgcgacgagcatggatcgcgcacttacgcgatcgaggattgcacgccgaacgtactcgaattgcgtgacctgttgctcgccaaatcgcagtacacgctggtcaagctttcgccgatgttggattggcgcaaggcggtcgccgatttcgacgggaccgtacgcgaagtgcatatcgtggccaccggcaacgaatgcaaggaactgttgctggtattgggtcagcaggtgcatgaggaaccatccgcgccgcgcgtgttctgcgtgaacgacaatcagcggatcgactatgattccgccgcatatacgcagggcctgcgcattggcggcaaaccgctgccggaggcgaaaaactacttgtatgagccgaatgcgtcgattatgaaggccggttgcttcgatctggtggaggaacgattcggtgtgacgcaggtcggtccaagcagtcaccttttcgtgtcggcaacgccggttgccgattttcccggcagaggattcgcgattgaagcgatcggcggcatgaataaaaaggatataaaacgactgctgaatggcacgaaacaggccaatatcgcggtacgtaacttcccgcttaccgcaccgcagctacgcaagaaattgaagcttgccgacggtggtccggtctatctgttcggcactaccatgcaaggctgcgatcatgtgctgctgcgcacgtcgaaaatctgaaaaacaaaccggaatcgaaaaaagaaacaggcgaaccgggattggcaaggcagtcgcgaaagaccgcgtacgtttgcgaaagagcgtgaaacctacgaaaagattgcgagataatcgtaaaggggcatgcgaaaagggcgtctgaccgcacgttgtacagacgccctcaaatcgcaggaaaggcgaaactacgctttagcgccaccacatggtcatgatgaatccgatcatgatgatcgcgaatgcgatggccagattccacgcgccgatgttcggaatcgggtagtcggaagtcaggtagtagacgaccgcccagatcagaccgatgatcatcagcgcgcagaacagcggcacgaaccagcgtggattggacttggtgcccttgatggtttcctccacgcggcgggtgttctccgcctgacggttcatcatgcgctgcatctgcgggctcagggagtccttatcggcggtagcgttcagcaccgcttcgacgcgatccatcggaatgtcgtgatcgtcatcgtcgtcggaatcagcggattcgtcagaagtggaatcgacggtggtttcctcagcggcatcctgaacggtttcgttgctctcttcaacggcagcggtgtcgtccgtggactgcagatcgttctgatcgtccgcggtggtttcgtgcagctcttcgtcagccatcagcatagtctcctttaataggctaaaagtcataatagtgggtagactcgaaagcggcgaactcacagcgcaaaactgttcataatcagagcaaatgcttaatgggaatcaggaaggtccgcatggcgaagcacaccggcaagcacaccgcgaaacggtcgaaagcggccggagtggcggcattccttgtgctcatgttctccggattcctgctcgccacgaacctgcgcgtgaaccgttccgtcgtggtgaccaacgacaccgccgaactcgtggaacaacgcgtgaaaaaagtcaactccctgcagacggaagtcgacgcgctcagctcccgcgtgaacgatctgagcaaaaccctgaacagccaggacgacgccgaccagcaagacagcgaaagcgccggcaacggcaccatgctgcccgcggtggaaggccccggactcgtggtgacgctcgacgattcaccactctgggaaaacatggtcgattccagcggctccacctccaacatcaacgattacgtggtgcaccagcaagacgtcgaagccgtggtgaacgcgctttgggcgggcggcgcggaatccatgatgatcatggaccagcgtgtgctgttcaattccgcagtgcgctgttccggcaacgtgctgcttttgcagggcaaaaagtattcgccgccattcaccatttccgcgatcggcccggtcgagacaatgaaaaaggcgctcgacaattcgcaggaagtgaccatataccggcagtacgtcagcgcgttcggcttgggatggcaggtcgacgaaaaagaaaaactccatttcgacgcgaccgacgcattgcaacagccgctgcaatacgcgcaggcgatgaacaacgaaacagacggatcgcagcaaacggacgaaacgcaggaatcgcaagaggggaagtaaccgatgaagcacgtggcaccaaaacagcgtcgcaaaagcgtggtctggacgatacttggcatcctcgccgaactcatgctgaccgcggcggccgtctgcgcgctctacatcgcatggcaaatgtggtggacgggcgtgcaggccgaacacaaccaaatcgaaacacgccaatccgtatcatggtccgacccgggacaaaccgacaacgtcaccatcgcgcaggcgcaggagggcgatccgccaacgcaaccgcaaagcgcgcaggaaggcgagctgatcgcccaagtctacattccgcgattcggcagccaatggcaacgcaacctcgttgagggaacctccctcactgaactcaacaaacacggcctcggccactacaaagactcgcaaatgcccggccaagtcggcaacttcgccttcgcaggccaccgcaatggctacggacagcccctcggcgatgtcgacaaactgcaggaaggcgacccgatcatcatccgtacgcaggattactggtacgtataccactacacgagccacaaaatcgtgctgccgaccgacatcgaagtggttgccgccaaccccgaaaatcccggcgctacaccgaccaaacgcatgctgaccatgactacgtgcgaaccgaaatattccacgccgacgcaccgctggattagctacgcggaattctcatactgggcgaaggtgtccgacggcatcccccaggagctcgcatccaccgactccaacggcaaagtcaaattcgtcaacaacgaaaaatcgtcgatcgtcgcatccgtcagctcgcttgaaccgtggattttcggtgcgcttgccgcatacgtgatcatcttcctttctgcgctcgtggcatggcgttggccgtacctcgccgacgtgcgcgcgggacgtcgcgaaaagccggaattcagcttatacggagggttgatgcgattgcagccgggcgtacttccgattcgactcgtgctgatggcgttgctgatcttcgcggcggccgcatcgtgctttgaatggctgttcccgtgggctgcgacgaatattccggcattgcgggaaatgtcgaattacacggccgtgtaaggcgtttttgcagttgctgcggttgctgcgtgagacgcgcgtcatgtcatgacatgttgcgcacgtagactgctgttcaaacgcaagtattcgcacaacgcaagcattcggaatattcggatgccggcattccaacgtcgataggagcatgatgaccgattccgcacgcattctggtcgtggataattacgattcgttcgtgtacacgatcgtcggatatttgaagacgttgggtgccacggtgacggtggtgcgcaacgatgcgatcgacccgtgcgaggacggtgtaatcgacgaatacgacggcgtgctgatctctccagggcctggtgctccggcggaatccggcgccagcgaaggcatgattcgcctgtgcgcggagcagtccaagcccatgttcggcgtgtgcctcggcatgcaggcgctggccgaagtgttcggcgcgaccgtaagccacgcgccgaccatcatgcacggcaaaaccagcttggtggagcatatcgacgatgagatcttcgaaggcgtcgccaatccgatgaccgccacccgctaccattcgctggccgtggagcccgattccgtgccggaagagctggtggtgaccgcgtggacgcaggtcgaccacatcgtgcagggcatcaagcattgcagcaagccgatgtacgcggtgcagttccaccccgaatccgtgatgacgcaggacggctaccgattgcttgcgaactggctgaaggtgtgcgggcaggagaacgcggtggagcgttccgccggattgcagccgaaggtcgcggcctgaagacacgaaaacgcaaggtgcaaaacgcggaaacacgcgaaacataagagctgtagggaatcacgaaatacgtgaaccgcgcgaaaaaatcgggaacgaatctcagaaaaacgtgagtgtcgtaaaacgcaatcgtaagaatgaaggcccgactggggatttccagtcgggccttcatcgtgaattatggcggctatcgcggttgtggcaatcgatcagttgccttcgccgggagtggtgctgtttccgctgttgttgttgctgttgttgttattgctcatgtcggtgttaggggtgtcgctggatgacttcttggtggtcagtgtgatggtcgatccgctgtcggcttggctgccgccattcggagacatcgattcgacgattgcatcgtcatcctgcggcccgtttacactcacttggaatccggcgacctgcaaaattcttttcgcctcggccagcgtggagtgggtaacgaacggcacgctgatctgctgcttgccggtagacacccaaatcgtgaccgcggtaccggcctcgaccgtgcttccaacacccggctcgacgcgggtgacggcgccggaagcgatggaatcggaatattcgctttcgatggtgatctgcgtcagaccggcctgcttcagctgctcgataaccgtgtctttcggctgtccgatcagattgtcgggaatcttggtcatgccggacgaaatgtacagcgtgatgatcgtgcccttggtctgctttgaatgggcggcaggatccgtgcttaccaccttgtctttttcgatggaggcattgtcgaccgtgcgcacgttgcccactttgaaaccggcggcctcaagaatggacttcgcatcgtcctggctcttgttcgacacatccggcaccgcgaccgactgtgggccggtggagaaccatacggaaaccgtggagcccttggcgaccttcttgccgccccttggattctgcttggtgattgtgcccttcggcttgctcgaatcggaatcctcgcgggcgtcgagcttcaggcctttggctgcgagctgctcttcgacgcgcgcctcggaaatattcgccgtggcggtgaaatcaggtacttccaccatgtcggctgtggagtcgctcttgttcagcatgaagaacacgcccagaatgaccagcaaagccaccagaccgcccacgacggagccgatgatgatctgcttcttcttgcgtgccttcgcggcctccgcacgctgttccgcacgggttttcgtggcaacgccgttctgcgggttcggcacggcctcgaactggcctgtgacgggattgaacgcctgcgtcgcggccgtttcgccggcaggggtcatggccacggtattcgcggtcatttcggcctgcttgcgtgccttcatattggtcagatcggtcaacggattgaatgcggccgccatcggcacaccgccgttcatgaacgtcagcagatcgttcttgaattcggaagccgtggcgtaacggttctgacgatccttcgccatcgctttcgcgcaaatcgaatcccacatcttcggcaatcctggaacaaccgaacttgggggagtggcgacctctgaaacatgctggtaggcgatcgccactgcggaatcgccggtaaacggcggccttccggtaagcatttcatacagcacgcaacctgcggaatacaggtcagaacgcatgtcgacgctttcgccgcgtgcctgctcgggagacagatactgcgcggtgccgaccacgccctgcgactgcgtcatcgtggcggcggaatcgtcgagcgcgcgggcgatgccgaagtccatgaccttgaccacgccctgctcggaaatcatgatgttgccgggcttgatgtcgcggtggatgatgcccatgcggtgcgaatactcgagcgcattgagcacgcccatcattacctgttcggcgtcgcgctggctcaaagcgccattcactttgagaatgtcgcgcaaggtctggcccttgacatactccatcaccagatacggcagatgttcggtctggccggtttcggtggtgacgacttcctcgcccgaatcgtagatgttcacgatgttgggattgttcatttgcgccacggaatgggcttcgcgacggaaacgctcaaggaagatcttgtcgttggcgaagtcggcgcgcatgatcttgaccgcgacggtgcgcccaagacgcgtatcgagcgccacgtgcacttcggccatgccgccacggccgaccagttggccgagctggtaacgttcaccagccaaagaggtaggcatgttgatgttcatccctgttccttcccatcagtgatcaaggagatatgaggtctgctgaccacgcggcgcggaagccttccacctgtaggcaccaccatcgtgtcagccagttgtgtctgctggtcgagcagacggcgttcgatgcgggacaatgtgcgcgacaccgtcaacgcgtccttcggacggtcaaggggatccttggccagcattgacatgacgaattcacgcagctgcacatcgacggagtcaggcagcggcggaaccggattgttgacatgggctgcggcgatgtcaaccggcgtggcgcccgtgaacggacgatgcccgcacaggccctcgtaggcgacgacgccaagcgaatagatatcggattgaggcgtggcatgctggccctgcgcctgctccggggaaatgtactgtgcggttcccaccaccatgccatcctgcgtgatctgctcctgattggtggagtaggagacgccgaaatcggtgatcttcacctcaccggaatcggacaccatgatgttcgccggcttcacatcgcggtggatcacgccatgcgaatgggcgacgaacaggccacgcgcggtctggatgagaatcggcagcagacgggtcggctccatcgggccgttctgctcgtggaacaggtcggccagcgacttgctgggcacgtactccataacgaggaagccgatgccgtcatgttcgtaatattcgaacaacgcagcgatattcgggtgtgcaagattggcggaattatgcgcttccgcacgcaggcgaagcagcttggcctcctgcgtgacgcccaagtcgccgcgcaacgccttaatggccacgggacgacccaactggatatcatagcctttccatacttcgcccatgccaccctgggccagacgggcatccaacctgtagcgtcggtggatgagctgtccttcaatcagtttcactctgccagcgcctcctgcatcatcgccttcataatcggacccgccgcgaacgagccatacaaatccacattgtgtaccaccacggcaacagcgatcttcggatcgtccgccggggcgaagccgaccatccagccgtcgatggacgtattgccgtcaccgatctgcgcggtgccggttttcgcagccacctgcacgccgtcgatggccagattcgggttctccttggtgaccaccgcctccatcatctgcgtgagcttgttggcggtgcccgaactgaacgcgcggctcatcacctgcggcttggtctgcgaaataacagacaggtcggaggaacgcacgcgatccaccagcgtcggctgcatgaccttgcccccgttcgccacggcggccgccaccagcgcgttctgcagcggagtcaccacggtgtctccttggccgatggacgccaaagcgagcttgtcgtcggtcgtgtcggtcgggaacttcgacgccacgctcatccacggcgtgcccgtggaatcggatccgtcaaccgtgatcggactgtcgaaaccaagcttcttggccatggacgacaccttgtcatcgcccaaagccacgcccagctgggcgaacgcggtgttcgacgaatacgccatcgcgtcttccaacgtgatcttgccgtccgaaccgtcggcctgcgacaccgcgttcgtcaactgtgtgaccgtgcccggaagcgtgtagctcgatccggccggaatctcggtgtcggtctggtattcgccagtttccagcgcggccgccgccaccaccgttttgaacgtggatcccggaggatacagctgcgaggtggcacggttgagcatcggattcgactcgtcttgcgaaagcgtggaataattgccgttcgcttcggacgtgtcgtggctcgccagctggttcgggtcgtagcttggcgtgcttgccatggcgagaatacgaccggttttcacttcgatggccacggccgcgccgtcattgttggcaagaccgttgtaggcggcctgctggattttcggatcaatggacgtttcgatggtcgcgcccttgttttcctggccggtgaacagcgatttgaaccgctgccataccagctggtcggattggcccgacagcagcgagctacgcgacgcttcgataccgttccagccgcgttggctgatcgagaagaagccggtgaccggcgcgtacagttcgccggcggtataggaacgctggtaggagaacgcgtcgttcgaagggtcggatttggcgatgacggagccgtccgaagcgaggatcgcaccgcgcggagcgccatactcgtggtagagggcgcgggtgttgcgcgggtcgttgttgagttggttcgcgcgaatcgccgtgatgatggtggtggacatgcccaggatgacgaacagcgccaccacgatggtgaagagttggcggagtgacttattcatgcttggctcccctctgacatgctgtccgatacgttcggagtgcccgatgggggagcgggtggtacgactggcgtgcctgaaaccggcgtctccgtggagatgatttcagtggcctgcgcggaggcctgcgcggaggccacgcttctgcgggcgcggctctgcttgcgggcgcgcagcgcctgcatcgcctcatattggaacgtgtcgctatcgatatcggattcgggtttgttcgccgagttggaaatcaccactaggagtgctgccaacatgtaattcgctatgagtgaggatccgccggcggccatgtacggaagagtcaaacccgtaagtgggatgactaacgtgatgcctcccaccacggtgaacacctggaaggccatggtgaacacgaggcccgatgcgagaagcttgccgaacccatccttgattttcatcgcagtgatcatcccggcggcgatgatgagcagatagagcatcagaatggccatcagaccggtgaggcccagctcttcgccaagtgccgcgtagatgtagtcggagttggcgatcggagtgagcgacgggtgaccttgcccaaggccggtgcccatcaagccgcctgatgccaggccgaaaatacccgtgacgagctggtaggatccgccgtactccttgttgtactgcgccgagtcgaacgggtgcagccaggcgtcgacgcgcgcgccgacatggctgaaaatattggccgcggcgaacgcgcccacggcgaacgcgatgaaaccaatcacaatccaactggtgcgccccgtggccacgtacaacatggacacgaacatggcgaagaacatcaacgacgtgcccaaatcatgctgcacgaccagcacgcccatcgacacgatccacaccacgatgataggcccaagatccttgatgcgcggcagctgcaggcccagcaccttcttgccaccgaccgccagctggtcgcggtggtcatacaggtaggaggcgaagaaaaacgcgaggaacagcttcgcgaactcgcttggctggaacgatcccaaaccgggaatcttcacccaaatgcgcgcgccatactgttcggaaccgatcaccggaagcatcggtgacagcagcaacaccaaaccgatcaccatgctgacgtacgagaaccgcctcagcacacggtaatccttcatgaagatcaccagcagattcgccaaaaccagcgctatcgacagccaaagcaactgtttgaacgcgacggacgtgttcgaatcctggtcgatgcgggcgatcatcatgatgccggtgccagtcagcaccatcacacaacacatgatcgcctggttggcatacggctggaaacgcagcggcaatccccaggaagtcaggaacaatgcgccgacaaaagcgagcatccacaaataattctgcggaaaaccgccggtggtgcgttcgaacatctggaagaacgcgacgccgcaaatcagcatgctgaacagcagcaggccgaattgcttcagacgggttgccatcatgactggtcaccgcctgacttgtttgccgaagcgtcgtccgatttgtctgatttgcccgacgacttgtcggaagtcgtaccagaggatttgttgtcggattcgccgtttgccttgtcttgttccttctgcgcggcttcgtcctgctgttgcttcaactgctttttgatcagtcgcgtatgcgttttcgcctcgccgtacgtgtcgaaggaaatgccctgcgcaagctgttcctgccagcttggcggcagttcgctcgtcttcatatgggtgtcggtgacggcgtgcgacagctggaagccgaacaggcttgtcggcacgccttggaaaatcgccacttcgccgttgtcgtcgccgatgtagtacttggtttggctccaacggtaggttgcgaacgcgccgcccgccagtcccagcagtaccacgatggtgacgatgatggcgatcacacggttgcgtcgggtgcgcgtgcgcttcgttttgcgctgctcgatatgctcgttgcggatggctttggcgacttccggatcgttcggatcggcggaaatgcggccgtcgtccttctgtacgacggggatttcaccggtgtcgggattggtgcggtcgccgttctcctcgcgtaccgtggacggttgcgccacgcgctgttccggaggattgtcgtcctcgttgggattcttgccgttgcgcagtgctgcggcacgggcggccggcgacttcttgccctcgcgcagtgcgggagcggatgcgaccggctcgttgatgatgtcggcgatcggttcaaggcttgcgctggccgcgccgccaaccaatggcgtctgatgcggcagatcgaacgcgtccgcgtcaagggcgagcgtcgcgtcggcgatgaccgcggtgacgttgtcggtgctgccggcacgaagcgccatcgaaaccagctgttgcgcgcactcctcctgatcggagcaggcggacagcacctcctgcaatgtggaatcctcaagcacgccgcacaaaccgtcggagcagagcagccagcggtcggcaggatgtgccttgcgtatggcgatgtccggactcgaatcgatatcgaaatcacccagaacgcgcatcacgacgttgcgctgcggatggttgcgcgcctcggcctcgctgatgcggccggtgtcgatcagatgctgcacgtagctgtggtcggacgtcatgcggatcagacggccgtcatgcagcagatatgcgcgggaatcgccgatatgcgccaaaacccaatatccggccaccaatgcgaccgacgtgacggtggtgcccatgcccgcgagacgacgttcgcgcttcgctttgccaacgatcgcgtcatgcgcggccataaccgaggtttccatcatgtgggcgataatctggacatcgccctgcacgttgtcttgctcgatatgcgccaatgaacggatggcgatggtggaggcggtgtcgcctcccgcatggcctcccatgccatcgcagatggcgatcagatgctcgccggcgaacgcggaatcctggttgttggaacgtacggtacccacgtcggaaacgacggtggaatacatgaacagcggttgtgaagcgggagaagtcggcaaacgggtcacctcaattcaaaggtggttgcgccaatgcgtacgggaacgcgcgatccgagaatcatcggagcgttcagacgctgctggttgaccacagtgccgttggtggaacccaggtcttcgatggcccacttgccggtggcgggatccgtatagacgcgcgcatggtgggacgagacgaattcgtcgtccagaaccacggtgttcgaagcggaacggccaagcgtgatggtgttgccggacaaagggacggaactgccggcaagggggccatcgatgatgaccagcaaggtgggtttggcgcttgatgtggcgctgacgactggtgccgggacggccacgggcgcgggcgcttcgacggccttgcgcgcgcgacgctccttacggcgatgagcccgcgacttgcgcgggctgagcgtttccacatccctgtacagcgaacgcaccgtacaggccacgaagatccagagcagtacgaggaagccgtacttgaggatcgcgaaagtaagttcagtgagcatagaggcaactcccgaggttggggttggttactcctgatcctgcgaagaggcccaatacaggattcgggtgcggccgatggtgatcgtgttgccgtcgagcaacgtggccgcctcgacatgatggccttcgacatacatgccgttggtggagcccagatcgcgtgcgatgacggtgttgccgttgtcggtgatgtcgatctgcatgtggcggcgggagatgcccggatcgtcgatcacgatatcgcagtcggatccgcggccgatgatggtcttgctttccgtgagcagatactggtgttcgccgatttccagcatcgggcagtcttcggtctgcgcgtcggtggtgacgggcacggtattgccttgcacggattcgctcgtcagcttgaaattgctcttggtgaggtcaaggtcctcttcgaagatcaccacgaccggaccgacgaacgcgtaatgctggtccttcgcgtactgggtgaggttgtcggccagctcattggccaacgcttccgcgccccattcgacgatgttgttgaaatccggcgtgctcagcttgaaacggtactcattcggcgccacggtacggtctcgcgtgacgggcatggcctctttgtcaatctcacgttccagagcgctggaaaggtcgacgggctgcaggtccttggacccgaacttggcgaaaaccccgttgacggcgccttccacgcttttctcaaatcggtcgagaacactcatgcttgtccctttctatcctcacccatcctacgcggtagagcgccgagcgccaattcgtaagtcctttaattgcaaaaatttcatgcataaatccatccccagcatcatttagggggtatttatccgcgaatatgactaccttcgcccccgatttccacgatgcacgaattcacggaaggtggaattgggatggtgctaggttgggagcatgacagatgcgattcgacagttcccccgtaaaaaagcacgtaccttgcgattttcctgcggcgctccgcgttcggcgcgcgtgattgcagacggctcccgcgcgctgttcctgcgttccgacggtccggaagacaccgtcacctcgctgtggatgagcgtgatcgacgaagacggcaacatcggtgagattccgctcgccgatccgcgcgtattgcttgccgacgccgacgcggaagacgttccggcggaagagaaggcgcgacgcgaacgtgcgcgcgaaggcggatccggcatcgtctcgtattgcgtcgacggtgccggcaaccgcgtgaccttcaccatcaacgggcagcttttcctcaccgaccttacggcgggcgcgacgcgagccatcacgatagaggaagatgaactcaaaccggtgctgaacccgcgcatcagtcccgacggacggcacatcatgtacaccaccggcacgtatctggtggacgtggatctcgccaacgatgaagaaaccggcgacgcgatttcggtggtcgcctcggcaccgcagaacggcgaatggaaaatcggcttggcggaattcgccgcaggcgaagaaatggaccgctacgacggcttctggtggtcacccgactccaaatacgtgctcttcgaaacctacgacgaatcccccgaaccgatctggcatctgtcggaccccgcgaatccaaccaatccggcgcaagccaaccgctatccgcaagcgttgaccgccaatgccgacgtgcggctgaccctgctggaactcggctacgacagcgacaactgctgctacggggcaatcgccaacgaagtgcagtgggaccatgaatcctacgaatatctggccgccgtaagctggagtgaaggccacgatccgatcatccttgtgcaagaccgtctccagcagcatgatcaggtgctcgccatccatgtaggcgagccgatcgccaccatgcgtgacgcggaaaacggcttcaccgacgacaatggcgacgaggtcgaaaccttctccatcgccattcccgaatacgcggaaggcgaacgccccggcaccacgcgcgtgcttgaggaacacggcaacgactactggctcgacctcatccacggcacccctgcattcactccggatggacgcttgatctgcgcgatgaacgacatggacgtcgatacgaaccgactcaccgttgatggtacgcccttcactccggccggactgcaggtgcgcgaagtgctcgacgtgaccgacgacgacgtgctgtgcgtggtgcagcgcacccctgaaatcctgcctgaaagcgacctgccgttcctctggcagtcgaatgcctccgaccatgacgcccgcagcttcgacgtggtgtcgatccgctatgacggcacatgggaacccctcacctacgcgcccggccagtggagcatgtctcgcgccggcaacggctgcgtggtgaccggacggggcatggacgacgcaaccgtgcaaatgcagcattgcatgaacatcgccacaaccgacgaaaatggtacggacgtggcgtcaatggtggtcgcaccaatcgaaaaccatgccgaaacccccggattcacgccgaacgtgcacttcacccgactcggcgaacgtgagctgtacacggcgatcgtgctgccctcatccgatagtgaatacgcgcacgaagccatcctgccggtactcatgaaaccctacggaggccccggcttccaacaggtcatcgaaagtcaatccttctattgggacgcgcaatggtgggccgaccaaggctacatcgtggtcaccaccgacggacgcggcaccaccggacgcggcccgcaatgggaccgcgccatctacgaaaccatgaaatccgtaacgctcgaagaccagatcgacgccgtgcgcgcgctgccggaagcgttggaagcgctggctggcgagaatgcggcagccaacgttccgcaacccgatctcagccgcgtcgccatgatcggctggtcgtacggcggattcctctccgcgctcgccgtgttggaggcgccggaaacgttcgccgcggcctgcgcgggcgcgcctccgaccgactggacgctgtacgacacgcattacaccgaacgctatctcggccttgactcggccgtgtacgaacgcaacagcatcatcgccgacgcgccgcagcttgatcgcccgctcatgctcatccacgggttcgccgacgacaatgtgacgatcgcgcacagcctgcgcctgagccaggcgctgatggcaaccggacgtaagcacacgttcctgccgctgaccggcatcacgcacatgaccaacgacgagacggttgccgaaaatctgctgatcctgcagcgcgatttccttgcggaagcgttggggtgacggcaccgtgacgacagtgcagtaacggtaacggcaacatcgcaaacgaaagtgctgcaaagcgccgtaggaagacaaaacgcgttcccctgcgattcccggactgccaagcatccgaacgtcgtgggcgaacgcgttcccttctcgaatgccaacataaaacaggcgaaaacgacttcgcaagcgagggggtaccacatttgtgtaccccccccccaaaaaaaatctgggcttgaaaaagacggaaatcggtggattgggctcgtcccaaccctgatccgcagctatggtcaaacctgcacttgttcaagcaaaccgggcgaatcgtcgatgacggtcaccggaatgtacgcaaacaacgtccaactgccgtcctgcgcagacgtggtgagcgtgccctgatacgattcgagctgcttcttgaacgaggcgagcccgtggccgcccggtagttcgtcatcgcgctcgtcagctccagccatgtcctctttcatgggattgatttgcgtgatttcgatggcattcggccggagcatcaccgaaagatcgaccttgcttcccggagcggcatggcgtgcgatattcgcatagatctcgcgcagcagattattggcaagttcggcgattgcttgcgatgcgctcggcttgccgcccgcgcagtgccggatggacgtgatattgaagccaagcttgcgcaagcgacgatcgccgtcatccagtgttgctcgcagcagattggccaacgcttcgccgtcggcgtcgccggggagagtggtggcgtccatattcaattcgtcgatgacgcgatgcacgttcgtcaatgcggaaagaatatattcgttgatttgacgccagtcttcggcatcggctgttgtggttgccgtagttgtggttgcgttggcagggtcagcagcgacgccagggccgctagagttgccaccgatatgccgttgcgtcacaaacgacgccgctgacaaatcgcccgtcaccgcatcgtgaatggcatcggcaatgcgtgcgcggctttccaattcctgcagacgattcttgttctgcgccgcttcgaagcttttctgcgttgttttttcgctccaactcaacgtccgaccaagcagtagcaccatggcatacatgctgaccatggcgacggggttggtatttgggtcaggggggtcaatcagcagaatgttaacaacgtaatatatgagtaacgttgccacgataatggcattagtgctgtatgcgagcatgccataggcgtaaagctgcgcgggaagagaatttcccaaatgcgcgtagggagtaaacagatcgcctatggaggcaatcacgagaatcgccaccgatgtacttttcagaaacagcggagacagtacgagcgccgtaaccagcatcgcaacccatatcacgccaaatatgtcggtaggaggctcgtagcaaacgccgtatatggtccatgcaagcacgatcagcataatggcgaaacggattggatgccacaggttcggatgctgcgtgcgcatacggttgcgccacgcaatgtactgagttgcgggtttagagcgcattggacctcacccacagtgccactgcctgacgcgaggtcttgcagttgagttttcttaaaatactttgcatatgtttgcggatggtggcttcggaaatccccaaacgctcggcgatgtcccggtcaagcatgccctccgcgcacaaggaaataatctgctcctcacgaacggtaagcgcgggagtggtctcagcctccctgctgatacgcagattggccaacgcagacggctcaaatccctccatcacctcgccattgcacatacgcataataatctgcgccaactggtcggcattctccttaccaaccaacccttgcgcaccagcctcaaccagcttgtcccgataactattgatggaaaaactggttacaccgagaatcggcatgcgctggcccatcaaacgcaaccgacgacacgtggcggggccttgcaatccctccatcgacatatcgagaatcaacaaactgacatggccgttcgcatcctggcaacgttctatcgcctcacagcctgaagtcgccgtccacaccacatacgcggtcggcactttgctggcaatgacggcactgagcgaatccagcgctcgcggatcattgtcgaccagcgcgatgcggtgaatcttgggatgcttttcccgcgtggacatcatgcgatcattttccttttccgcacagccattgcagccatgttgggcagttggaatcttgggcagcggagatatcaccgttgttgtcaacgggagttgccgccgcgtacgcatacgttggtgtgccggtgagagacagcgttaccaccatcagcagtgaaacgaacttcatacctccatagtatgcgaggatggcgcgcgggggtgacgattcggttgttccggtacgccgttgatgcactgacgcatcgttatacagcgcgtaggcctgtgcttagtttcgtcttggcgccgttcgcctaagatggaaccatgactatcacgctcatcgacgaggcgcgctatgacgccgaaatggacgctacggtgctgcctgcgctgcaggcttgcatgacggaaggttggatggaaccggccaccgtcgattgggaaggcaaggcgttgcccaagttggagcgccccggccggttgcattactaccgctacgacgcgcgcacattcgacgcgttgcgcgaggaaggcgcttcgggcgtatttcgtggcacgatcgtcatttcgcacggattcaccgaattcggacgcaaatacagcgaaatggtgtggtactttctgttggccggctattcggtgtgcgtgttcgagcatcgcgggcatggccattccgcgcacgatatgagcaatccaagtttggtatggattgacgattggcggcgatatgtggccgatttcgccacgtttgcacagactgtggggcgtgaggcggcggatggtggcccaatgtacctgtactgccattccatgggcggcggcatcggcgcggccgcgctggaacgttacccgtcgctgttcgacaaggcggtgctgtccgcgccgatgatcgcgccggtggtcggcatgccgacgtgggtcgcacgcattgtggtcggcgtaatctgcgggcttggcttcggcaaatcgcgtgtgttcgggcatgccgatttcgacggcaacctcaatctcgacgactaccgcggggcctcggaggcacgcatccgctggttccacaagcaacgtttggcggacgtgacgtgccagaccaacgcggccacgttcgattgggcaaaccaggcgatggcgctttcccgagccgtgctcaaacctgacatgtgtggagctatcgaagctccggtattgctattccaagccggacgcgacgtgtgggtgctcaacggaccacaagatgacttcgtcgaacgtgtgcgagaaggcggcggttccatcgaaaaagtgcgatacagccagtcattgcacgaaattttctccatgccgaatgctgtgctcggatcatatctcggcaaaatcctcgattttttgtcagcgccgaacgcaagcttggcggaataaatctgttttgcataactgacgtttaatatgcgtaccgtgtgcgttacaatcgccgtgaatttgccgtgaaagccgtggagagagcgagggcaggccgtggcaaagcaaacgtcgggacaggcgtcgcaatcgcagaaaacttccgaatcgcaaaaaaccgcgaaaaaaactacgaaaaaaacggaacatgtgctggaacagacgccgaaaagcctgctcatcggcactggcatgacattgctgggcggtgccatgtggggtatgaacagcaccgtggccaaactgctgatgcgcgactaccagctggatccgatctggctttcctgcgtacgcgcgctattcgccagcctgatcttcctggtcggatcggccatcaccacaccgcagaaactcgccggagcggtcaaagacgtcaaatcgtatccgaaatatctggtcacgacactgatctgcgtgcttctggtgcaggtctcctacctgatgaccatcgactggacgaactccggaaccgccaccgtattgcagacgctcaacctgatcttcgtgctcgcctgggtatgcctgcgcggcaaacgactgcccctcaagcgtgaattggtcggcgtgctcctggcgttcgcaggcacgttcctcatcgccaccggcggcaacttcgcctcgctgtcgttgccatggcaggggctcgcatggggactggttgacgcggtgagcaccgcggccatgtccatcctgccggtcgtgctcatgctcaaatggggcaacatgaccatcaacggcatcacattcctcatgtccggactcatattatgcccgttcgcgcaaccgtgggcgaacattcccgcactggacgcgcgaggcgtgcttctgctgctctacaccatcgtatgcggcacgttcctcgcgttctggctctacatggcaggcgtgatgcgcgtcggcgcggtgcgtgccaccatgctcggcaccagcgaaccggtcatggccaccatcaccgcagtggcatgggccggcgaaacgttcaccttcaccgacctgaccggcttcgccatgatcatcatcatggtcttcctcgtgcgctgaccgctcgccatagccataaactgtccgattctggagaatcggacatccagaacgcaaaacccataccttagttgtccgattcaccagaaacggacaactaaacaggtaaaactgccccacagttgtccgtttctccagaatcggacacttatggtgcgcacgtcggtgccggcgagcacgtcggccagatgcttggcagtgttcgggattgccggcagagtctcttcggtccaagcgccgaccgcgttcacgaccacgtcgaatactcgctgactgaagtcggcgaaagcctgcgcccgatcatcgatgcgatgaagacatgggggaaccattaccgaaacgaacacgagttctgattgttccagtcactggagttgtcgggagccgctgagctctactgccgctcgggaaacgaaaaggccggaacctttcggctccgacctttcaccatggtgcgagcggggggagttgaacccccacgagcatacactcactgccacctgaagacagcgcgtctaccattccgccacgctcgcagacaatcgactaatctacaccaaaacctgcgcaacctcaaatcggcgtgtcgcgccgccattttccgtaggaaaattcaagcggcgcgacgcgaggagggaggaagccctgtgggcttccgtacgacggagccatccttgatcccgccattttccgtaggaaaattcaagcggcgcgacgctctgtgtgtccgattctggcgtttcggacatccagcgagtgtttttaggttgcttacttgtccgtttctccagaatcggacaagtagaacgtgagataagcattgtggttgtccgtttcgcccgaatcggacatgtagggcatgaaacatgtggtgtggttgtccgattctccagaatcggacacatctggtgacaagtctgagaacgagacggcgagtgcgggctcgccatgcatgaaaaggcgccgacgggtttgttcgtcggcgccttggaatgcggaagtatggctcagcattcgtttgggtggaaggcccaagtgaaatgaatcatccgcgggaaccgttggcgtagaagcgggccagggtttcgtcgcggaattcgtcgaaatatccgtcgtcaatcgacgcgcgaatatcgtccagcagcttcacgaagaaatgctcgttgtggatcgtcgccaatgtgaaaccgttgaattcgcgggcacgcaacgcatgatccacgtaagcgcgcgaataatgcgtgcatgtgtagcaatcgcagccctcttcaagtgggccaaaatcatgcttgaattgcgcgcgcttgatgttgtaacgtccgccgcgcgtgaaaatcgcgccatttcggccgcaacgcgccggtgcgacgcaatcgaacgtgtctccaccattctcgacgcatgcgaaaatatcgtcgactgcagcgatgccgagcacgtggcgcggtcggctttccggcatcgcatcgcaaatccaggcgcaagtgtcgccgataatgcgcttttcaatcgcacctccaataccgacgccgtcgaaatccaacgaagcgatctgttcggccgcatgcctgcgcaaatcctcataattcgcgccctgtaccacgccatacagcgcctgatacggcttgccgacgcgctcttcggtaagtctcttatgctcggcaacgcaacgctgcgcccaacggtaggtgcgttccacggaacgctcctggtagccgcgcgtgttcatcagtgtggtcagctcgtcgaacgcgaacatgatgtcggcgccgatcttatgctggattcccattgaaatttcggcggaaaaacggtgcagtgagccgttgagcggcgatttgaacgttacaccgtcctcgtccacgaacgcgagacgctccttgccttcggcgatcacgtcgtctgatttcatgccggtcacatccatggcgagggttttcttgaagcctgcgccgagcgaaagcacttggaaaccgccggaatcggtgaaggtcggaccgttccagttcatgaatttggcaaggccgccggcttcgtcgagcacttgttcgccggggcgttcatacaggtgaaacgcgttggacagcaggcattgcgcgccgaggtccttcatggtttcgggcagaacggctttcatcgcggcctgcgtggccacgggcacgaacgctggagtgtgaatatcgccgtggggggtgtgaataatgccggtgcgaccatatcgtgcgccgcctcgccccttaccgtccgccgcgtcgggaaggcggtttttctgttcgaaatagaaggcgtcgcggcggcccggcttgcctggttccgctccacgcggatgttcgatgagattttcggacactgcggttgccgcgttttgcgtgtcttgcgctgtgccggtagatgattcggtaaggcttgtcatgcggaatattttatgcgatagcagcgattcttgaaagtgctgcaaagaatgcgatcggtgaaatgaaaataaggaagatgtggaaagtgcgatgaaggtgccgatcgcattttggtgcgattttcagattcaatggtgatgttgaacgtatttggctgctactttcaacaaacattcaggaaacttccagagcgagtatctttactcatagatagcagttcgagcggcacgattgctgatttgtgaaatgccgcgagacgaataaggagcgaaaatggctgaagagaacgaccagaacgccgtgcagccgcagaatgacgaacaacagaccgtgccgatgccgtcggttgatgcggaacagacgcaaacttacgcaggtgagccgtatgctgcagagtcggctaccgaaccgattgacgtgcagggcggtattgaggatcagccgacggccgccatgcctgttgcgaacgatggcgcttcggcggaatccgcggctgcggcgggcaatacgccggattatgcttccgcggcgggcgaacgtaccgtggttggcggttccacgcaggatgcgccggcccagcagtaccgtccggcaccggaatatggtgcgtacggtcctgtgccgacgcagccggctgatggcaccgcagccgcgaacgatactgcgaatggtgcgccgaacatgcctccgcagccgcaatatggcgcgtacgggcaggcttccggacagcagccgcagcggcctcgcaatcctttcttcgggaatccgtatgtgggtggaaatcagcagaacgatcagcagaatacgcaatcgaataacggcaatccattcatgaagcccgctgcgcaaggcggagccaacgtgccgccagcagcgccgaatactcccaataacggcaacccgtttgggaatccgaataacggtaatccgttcggtgccccgcagcagaatggcgcagcaaccaagccgaagtccgcttccggcgtgaccgggcatgtgatgaccggcgtggtggcggccctcgtctccgcggcattgtgcctcggcgtcggctacgcggcaatcaccaatggatgggtgaccgtacccacctccagctcactgaccagcgtgaagtccaacacgtccggatccggttcggcgaaagccaaatccggcgaggccgcggactggagcgcggtggcgaaagaagtgtccgattctgtggtgtccattgacgtggcaaccagcgacggcagcgccaaaggctctggtgcaatcatcagcgacaaaggctacatcgtcaccaacaaccatgtgatttccggcgcgaagcagattcaagtgacgctcgccaacggcaccatctactcagcgcaaatcgtcggcaccgacaccaccaccgatctggccgtaatcaaactcgacaatccgccgagcaatctgaaagccgcagaatttgccgattccgacaatcttgccgtgggtgaatccgtgatggccatcggcaatccgctcggctacgatgacaccgcaaccgtcggcatcgtttccgcgctcaaccgcccggtgaccgtgtccgatgacaacaacaacgacatcgtcaccaacgccgtgcagattgacgcggccgtcaacccaggcaattccggcggtccgaccttcaatgcggccggccaggtgatcggcatcaactcatccatcgcatccaccacaacgtcttccggcaccgccggatccatcggcatcggcttcgccattccgtcgaacctggtaaagcgtgtggctaacgagatcatcgacaacggcaccgtgcagcatgtggcgctcggcgtcaccatcaagagctccacggtcgaggcggacggcgtgacccgcggttgcacgcaggtgcagtccgtggtcgacaacagcccggcggccaaggccggagtgaaggccggcgactccatcgtggcgttcaacggcaaggcggtgaacaacaactattcgctgctcggctacgtgcgcgcctccgccatgaacgacaaggtgacattgacggtcgtgcgcgacggcaacaccatggagcttgacgtgacactcgaccaggaggaatcccaaacgaactcctccaacagccagaaccagcagaacaacggcaatgatggccagagccagaacggcaatggcaacggttacggtaatgacggcaacggcaacggaaatggacagagcgacggcaacggcagcaacggctacggtgacggtggcggcctgttcgacccgttcggcctgtggtaaagcgagatgttgatgcggtgcgtgaattgacggacgcaagttgttgcggtgcgcaagtcaagactgttgggctggctaaaacgtttcgcgacatgcgaacggacggaagccacccgataggctgacggcgaagacgcggctggcaccacgaaatcgcaagtacaacgaaaaccgcgaaaatcaacaaaaagcaagccaaaagaagaatgcaataagggctgtgtgagcaatcgcacagcccttattgctgtattgcggcacaaaaatcgcaaatatttgctatgctgaaaatatctttttacgccgtgtatcgatggctcgcgcgggcgaggcgccgatgggttaacaaggcgtccgatacgagcgtaaggagattctcatgcgtagaatcatcgatatttgctggcgactgtgcaaacaggttccgttactgccgattaccattctgtccgcgattccgttggcattgctgggggagtggaagccgtggggcgaggctgcgtgggattcgtggatttcgcaagtcggcgttgacgggttgagtgcgttcaatccgggcgttggacagtggattgtgatcgcgttggttgcgtacacgattgtggtgacggtacgcggcatgatcgacgatctgcggcacgggcatgttggcgtcgatctgctggcggtcgtcgcgattgcgtcgacggtcgcagtgcaggaatattgggccgcatgggccgtggtgctgatgatctcgtccggcgaggcgatcgaggaattcgcgcagtcaaaggccgaaagcaacctgaccgcgctgatcgacgcggcaccgcgaaccgcgcacgtggtcgtgctgcccggcatgcgggggcatgtgcacgcgtcgggcagcgagcatacggccgacgtgaccgccgacggatttcgtactgtcagagtgtccgattctggagaaacggacaaccaagacggtgaaaagcgtgcttttgcgtctgaatctccagaaacggacacaaaaggtgccgcgcagacgtatgatgcggctggagagcgtttcgaaacggtccccgttgatcaggtacagctcggcgacgtgatcctggtgttgcccggcgaaacggtgccggtcgacggtgagctgctgtcgggcgtggccacgttggacctaagcaacatcaacggcgagcccgttccccgcgaagtatatgcgggcgctcgcgtgatgtccggtgcggtcaatggctccacaacattgaccatgcgcgccacgcaacttgcgcacgattcgcaataccagaagatcctggagctggtctcgtcggcgcaagagtcgcgccccgctgtcgtgaagaccgcggatatgcttgcagtgccgtttaccgtgctttcgcttgcgattgctgggattgcatgggcgatttccggattgccgctgcgatttgcgcaagtattggtgcttgctacgccgtgtccgctgttgattgccgcgccggtcgcatatgtggctggaaccgggcgacttgccaaagcgggaatcctgatcaaagcgcaggatgtgctggaaaatctaggtcgcgtatcgcatattttcttcgacaaaaccggcacgctcaccgtcaagcagccgcaggtcgtacgtgtggagaagccgtttgagacgagttcgccgttcaatgaggaccatattctcatgatggccagcgtggtggaaggctattcggtgcacattctgtcgaaaggcatcgcggcggccggacgcaaggctatggatgatttgtatgcgcggtatgcggcggggcagaggctgtgcgtcgagcgcgatttgccggggcacgggcgcgactatccggtggtgaagaacattgtagaggagtccggcaagggtatatccggcgaagtgaacgggcatcaggtgcgcgtggggcggttcgcatacgtgacggctgacgaatccggattcatgccggtgctgcatatgccggatgcgacgtattacgtgtccgattctgccgaatcggacaaacgggagactcagaatgcgctgcggatgtccgattcaccagaaacggacatccagagggctaaaacgtgtgtttacttgtccgattctccagaatcggacactatgggagtgaggaacggggtgcctgacgatgcgcagcctgcagccgcgccctctacttccgcgtccgtcgcaacccaatccgccgctcgcaagcctgaaaccgcaaactcgctgtttgccccgctcgctcctgacgaaatggctgcatacgtggcgattgacggccgtcttgccgcccgcatcgtacttcgtgacgtgcctcgcgagaatgcgaagcgttctttggctcgcctgcacgagttgggtgtcaaggaactgtccatgcttaccggcgacaaggctgcgtccgcccgcatcatcgcaaacgaagtcggtatcgacgacgtgcagtccgaactgttccctgaagacaaggttgccgccgtcaagagcgccactgaatccaagcaccagaagctgtcgttgtggaatcgcatcaagcaacgcgtaaccggcgaatccaagaatcgtcaaatcaccatgatggtcggtgacggcgtcaacgacgcccccgtacttgcggttgccgatatcggcatggccatgaccgacggcacgtccaccgcggcttccgaatctgcgcaagtggtcatcatgaatgacgacattgcgtccgttccgcgggccatcgccatcgcgcgccgcacgaaaaaggtgatgttgcaggcggtgctgatcggcctcggccttgcgattatcggcatgatcgcggccgcgttcaatctgattcccgtggttgtcggcgcgttcatgcaggaagcgattgatgttgtcagcattctgtgggcgctcaccgtgcttttcgaccgtggcgaatcagcctgattgcgcctcgaaaccccgtatctcgcctatatatggcagatttggaggtctgtcagcaagtatttcgcttatatctggcaggtccatatgagaaaaccggacttagggggcgagaatacaccctctaagtccggtttctcaaaacagctctgccatatataacgcagatagctccggacgaacttcggaatctgccatacataaggcatgtataaggcagattcggaagttttgggattgtttacagcgagctcggggagatttctccagcgatcgatgtgtgcatccacttgccgaagtcggctccggtcacgccttgagacagcaggaacatgattttcgcatacgtggcttccagcgtcatatcgccagatccaattgcgccggcgcgtgcgatcgcatcacccgtctcgtaatggccgagcagtacttccgcctgctggcactgcgatgcaatcacaacgggaacgccatcatgcagcacgtcggcaatcacgtcagtcagtccaggctcgtcgcttggcacattgccgacgccgtacgcacgcaacaaaaccgcttccggccgcggcgtaagcatcgcttccaaccgtgccgcggaaatgccgggtgccatatcgatcaccgcaacatcatggcgagagtaaggctgaggcgacgtccaaccgcagccaaccgcagcggaatcgcccgcataccaatgccatggcgtgccagtgcgtgccagcgggccgacggaaggcgccgaaaaaccttcaaatgcccagctcgacgacttgctcacacgattgcccgcaaacaggtgatgtccaaaaaacagtcccacactgtggaatcgtccgctcatcgcggcattcagcgcgcccgtgacattcgcagtggcgtccgactcgatcttgccaagcggatgctgtgaacccgtgaaaatcaccggcttgccaaaatcagccaacgcatacgcaagcgcggcgctcgaatagctcatcgtatcggtgccatgcaacaccacgaacgcgtcggcatcatcgcggtgcgcacgcaaatcgtcgaccatcgtctgccaattgtcgggagtcgcattcgacgagtcgataagaggatcaagttcggtgaacgtgaacaggctcgcgtccatgtgcgcgtcctccagcagacggaacagccatccgcgagtgtcggcgcccggaatcaggccgttcggcgagtcaatcatgccgatagtgccgccggtatatgtgatgtgaatgcgcattgccaccttcttacgattgcctggtacttaataagtacttgcttgcgattgcgggatggacgaattccgatatttcggattcctacatcccgcgattctgcgactacttgcgattgtacgtgcatctgccgcgctcatcgcgtacgattaatgcagccacacgttggattcatctggattcagcgcaaacaccaacgccagtgcgcacaaggcgaagaagtcgtaagaaagtgcataagcacccctgtcgcaaatgcagggaatgcattaggctagagcgcgtgactgaaactcatgaacttcgtattgctgtaatcggcgccggccctgcaggcgtctactcctctgacattttcctgcgccagttgaagaagctcggcgaggagctcggccttggcactgccgcccgaatcgacctgttcgaaaagctgccggtgccgttcggtctggtgcgctacggcgtggcccccgatcatccgtccatcaaattcattgcgtcggcactcgaaaagacgctcgacaatccggacatccacctgtactgcgacgtggaattcggcaaggacgtgacgctcgacgaactgctcgaacgttacgatgccgtgctgttcgccaccggtgccgtcgaagacaagccgctcggactgccgggcgccgatctggacggcgtgtacggcgcagccaagttcgtggaatggtacgacggttatccgaccggcgctcgcgaatggccgcttgaagctgaggaagtcgccgtgatcggcggcggcaacgtggccatggacgtggctcgcgagctcatgcgcaatgccgatgatctgaaggagcgcaccgacattccggacaacgtatatgagggcatcaagtccaacaaggcgcgtgtgcttcacttgttcatccgtcgcggtgtggcgcaggccaagttctccgtgcaggaattgcgtgagatggagaagctgccgggagtgcagctgatcatcaacgaagacgatttcgatttggatgaagacacgattgaagaggccggcaaagacaagctgactcgtcagatggtcgaagagctgttcacgattcgtgagatggcggaagacatggaagatgacggtgacgtggattatgagggtaatccggctgaccgcaaatattacgtgcacttcaattccgctccggtcgaagtgttgggtgaggacggcaaggtcgttggcatccgtgtggaaaagaccgagacatcggcggacggcaagatgagccgtaccggcgaattcgaagagtatccggtgcaggctgtgtaccatgcgatcggctacaaaccggccaccgcgccgggcattgcgtacgacgagcgtcatgcgcacttggcgaacgcgaacggtgacggtcgtatcactacggccgctgaagccacggatgaagtgcgcgagcgtctgtatgcgaccggttgggcgaagcgtggtccggttggcctgatcggctccaccaagtccgacgcactgctgatcgtgaccaatatgctggaggatttgtcgaaggctgctgaaggcggccgtgtggccgctgatcgtgatccggagtccatcgaccggctgctggaatcgcgcggtgtcaagccgatcgacttcgccggttggaagaagatcgatgcgttcgaacgtgccgagggtgcgaaggaaggccgtgagcacaagaaggtcatcgatccggagcagatgcgcgccctggctcacgcttaaggtgggtgtttgggatctgatctgataggtcccaggtttctttcatgcgtcttggatgtccgattctggagaatcggtcacccaagacgcattttttatcctgtgcttgtctgtttctggtgaatcggacatctggagtgtccgaaacatgttctgtatgtctgtttctggtgaattggacatgtgatgtggacgaaggacttgctacttgtccgattctcccgattcggtcacccaaaggcctcttggcatgcatcggatgtccgtttctgcagaatcggatatccggggagaagctgagcatgcgaacttccgcaactgccccctagtcctttccgcagtccagcctccagcacatatccagcaaaaactcaggctccgtttctacgctagtgaccatgaacggcaaattgcgggtgcatggccattgcaatggcttgaagacaacgctgttattcgcgttgatgtggggcgtcatcatgctcatttggtgggcgaccggtggcggccagcgtacgcttggtatctacattctcatcggacttggctcaacgttcgcatcctactggttttccgacaaacttgcgattgcatccatgcatgcgcaggaagtcagcgagcaggaagcgccggtactgtacaaaatcgtgcgcgaactgtcggcgaaggcgggcaagccgatgccgcgtatctatatcgccccaaccatgagtcccaatgcgttcgcaacgggacgcaatgaacgtcatgcggcggtctgctgcacgcagggcattctgcagatgctgaacgaacgcgagattcgcggcgtactcgggcacgagctcatgcacgtgtacaatcatgacattctgacgtccgcgatcgcttccgcaatggcgacggtcatttcgtatctcggctattcgctcatgtatttcggcggcggcaattcgcgtgacgatcgcaatggttcatcttctaacggtcttggattgctgggcgtgctgttgagcgcgattcttgcgccgattgccgcttcgcttattcagatggcgatttcgcgtacacgagaatatgatgccgacgaagatggttccatgcttacggaagatccggaggcgctcgcgtccgcattgaataagatctcgaacggcgctgagacgatgccgatgcagaagactgccggtacgcagtcggttgctgcgatgatgattgcgaatccgttttctgcggaaggtttttctcgcttgttttccacgcatccggcgactgaggatcgtattgcccggttgatgcagatggggcaggagatgcgtcagcagggcgtgcagtccggatatttggccggtggctatgccacgagcggcgttgtggcggcggatattcggcaaggcggacgttctgcgatggctggtgccggtgggccgcaatttggaacgcagtatggatccgcgcatgattcgggcgactcggctggcagatattctcgcgactattcgcagcggccgcgtggttgagtcatccgtgatattgcggaaaattggtatcgcatgtcggtctgtgtccgcatacgcatccgttgcgtgctaaactgaagtttcgtgcccaaaaggcacaaccttgcggatgtagttcatcggtagaacgaaagcttcccaagctttaaaggcgggttcgactcccgtcatccgctccattcgaaacccttggaatcgttggaattccaagggtttttctattgccgtaaaagacccgtgaagtcaacttcgcgccgcgcaactgtcggttgcgtcgcaaaattcggttgcgagtcgcaatgcaaccgaaagatggtggcgtggaacgagacgtttatgacaagctgttgcttggcaatcgccaataatcgcaagtcgaggcgatatggaaactcgacgaaagggcggacatgagtttcaaagagaatctgcagtatctgcgcggttcgcgcaacatgacgcaggaacagctggcaatgctgctgggcgtttcccggcaggcaatttcgaaatgggagtccgagaaggcataccccgaaatggataagctgctgatgctttgcgacatgttcggcgtgacgttggatgatttggtcatgggcgacgtgcgcgcgtcggcgggctgtgggggtgcgggacgcgtggacttggctgctgatacggatggtgtggccgcgtcggttggggtggccgacgctgctgttggcgcggttccgggggtaatcgggtttgcggcatcgcaggtcgcaggaatgtccgattctggtgaatcggacgtgagggatacgaatccgaatgtttgtgcgtccgtttctggtgaatcggacgcacaaggtgccaaaaccggtgttcaattgtccgtttctccagaatcggacacgcgagatgggacggacattccgcaaagcgtgccccgacatatcgtgcaggatgtggttggctacgacagtcatatgaggcgttttgcgtggcttattgcgattggtgtggccgcaatcatcctcggcgtcgcggttggcatgttgttttcgccggaggggtctgtcttagggccgtcgccggtgaacgacgtgctggtcacggtatgcacgttggttggcgcgatggtcggtctcgctttgctgataccggccggaatcatgcatggcgatttccgccgtcgccacccgtatgtgcaggatttttacacgaatgaggacaagtcacgtgcgtcggtcgtattggcgattggtgttgcgattggtgccgtgctgattttggcgggcgtgtgcgtgcgagtgttttgtgacgagtttgttgccgacggagacgcggggtggccggacagcgttctgctggcttgcgtggccgcggcggtgttctgtttcattatgtctgggatgacgcatgacaaggtgaatgtggacaaatacaatcgtgaagccgaagaggaaagcgcgcgcgagggacgttccgtgccgcacccgacgatgagcgagtcggacagattttacagcagacttaccagtgcaatttgtggcgtgatcatgttgttagcgactgttgtcgcgttgcttatgctttttcttggaacggcgggcagtgatgttgacgcgtggatgaaggtgttctgggtcccgtggccgatcggcggtgtgctgtgtggcgtcgtgggcatcatcgtgccattggttaaggaggccaggcggcggtaaaccaacaaatagtgtccgtttctgcagaatcggacatgcggggtgggcggcaggtaggctggaatccgtgaatacggatcagaaacttcccgccgaatccgcaggcgaacgccccagtacccccctatttggtcatgccatatcacacgcggcgacactcatcggcctgttcgcaatcgtcctgtggggcttcatggccggcctcgtgcgactcgtttccgaatcgttcggcgccacgctcggctcggcgctcatctacactgtcggcggcatgctcctgctcatcgtgcgacggccgaaaccgattagccaagcgccacgcaagtacctcgtcgcaggcggactcatgttcatcgcatacgagacgtcgatctcgctgtcgatcggtctggccacaacgaacgcgcaatctgtggaagtcagcctcgtcaattatttgtggccgacgctgctggtactgatgaccgccgccgtgtcgcacaaacgcggctcggtctccgaagcgctgccgggtgcaatcgtagccaccgtcggcgtggcaatggcggtcggcggtgaaaaccttgacgtgcaggaagcggttgccaatatcgccagcaatccattgccgtacgcgctcgcgttcgcaggcgcctttatttgggcgatttacgcgaccgtgacgccatcgatgtccgatggttacgatggtacgacgattttcttctgttgcgttgctgttgtgctgtggattatccatttcgtttcgggcgacggtttgccagctgtagcgcctggcatcggcggctatattgcgctgctcgcatgtgccgcgtcgattgctggcggctacgcgtgctgggggtatggcatgctacatggcagtatggaaacgcttgcgatcggttcgtatgcgacgccgctgttctccactgcttccagcacgctcctattgggcgtgacgttgggcatgccattctggatcggtgtcgcgctggtggtggtcggctcgctgatcaacgtgtggtttgcgcgacgccgctgcttgtccgattctgcagaatcggacgcttgttggtgtgtgaggaggcgacatgtggggtagtggcggcgcagaggagcgccgggatggcgcagcggtacgtaagggaagtgaccgggcaggacaatgcccttacgcatccacgctagcttaggtttttgtcggctggtatttggtgtgtgttgccgttggcggtgatggtgatgcgtcgccaatgacgcgtccatgtgtgccagccgaaaccgatctaaaccggcttaaaccagcccgttcaaatccacctcgtcacatcaccttggtggattccagattgcggctcacccagttgttcaaccggatcaccggcttgcgcaacaccaatcccagcagcagcgaaggaatcaggaacaaggcgagatacaccatgtcaagcaggtactcattgccgtacgatccggccatcgcggcgtgcatggcatcgatggcgtgcgggaacggtaggaacgggtagagcatttggaagaacttcggcagcgtctcgatagggaacgtaccgcccgaaccggcgacctgcatcaccagcagcaccacggccacggccttgccgatatcgccgaacgacacggtcagcgtatacacgatattcgagaacacgagtgcggcaagccaccccacggcaaggaactgcagcgcatgattcgcctgcacgccaaggaaatacatgtcacccaggcaaaccagtgtgccctgcagcaacgcgagcagtgcgaagatcgcgtaccgtccgaaatactcgtggtcgaggcgcagtccccaacgtgaggcgttccccgggccggacgggccggcgacgcgcggcagcgtgtcgcccaagcccagcacatgcgccttctcgcggtccgaaattgtcactttcagcatggcgcacaggatgatcgcacccacccagattgacaggatcgtatagaacggcgccatggccgaaccgtagttcgcgatcgggtacactgagacgcgctgcagtgcgacgggcgcggaaatcagcgtggacagtgtggacgcgttggcggtggccagtgcacgtagttcgtccgattcacccgaatcggacgaactggcgtcgttgtcaccgtcgccaccatcgctgttgccgtcaccggcgttcccgcccgtctccagcttcgtgatcagctccttcaccgtcgctgccgacgagtcgagtttcttcgcgatcgcgccgagcgtggaacggatggatgtcacattcgtccccacatcgcccgtcacatcgtccagatcgtcggcggtgccgctcagctgggtgatcatgctgtcggtttgggagatcagcgtgctgactgtggaggcgagcgcgtcgattttcggcttgacgttcgtggcgtaatcgtcgcgcacattgctgatcgactgcttcgcggaggtgatgcggttcaggatctccttgcgggagcgttccgcggctgcggtatcctgcgtgacctgcgtggaagcgtctttcagctgctgcgcgagcttctgcgaatcgcctttggcggcttccagcagcgtgatctcccggtcgatggcttccagcagcgcctgtttcgcggaatcactgtccggtagttgttccaccgattcgtgcatgtggttgaggcttgtgatgtacgtgtcgtacagcgattcgctgctggagacttgttcgctcaacgttgtcaactggctggctgcggtgtctgagtccttgccgatcgcgtcgaacgccttgttcaccttggcagctacttggtcgaacgcgcctgacacctggtcgagcgcggtgttcactgaggaggtgacgttcgcacctgccgaagtgaacgacgtggcacctgatttgccttgcttcaacgcgttctgggcctgtttgcccgccttggtcgccgaggcgagcagtttgcccgtggaatccacgatgtcgttcgccgagccgagcagctgcgaatacgacgttacctgctgcgatgcgccgctcagcgtatccgccatggtggtgagattgccgttgaggttgcgcatgtattcggccatttgcgggctttgcgaatagtgtaggatgcttgaggccaggtcgagtccgacttgcgcgatcgttttggcgaaggttttgtcgattgtgttgaccacggttgtcgcgccctgatcggtgatatgcggggcgatcgggttgattttctcgttcagatagtacttgagctgcgcgtgtttgatgtcgggggagaacagcgtcatcatgtcggcgctgaaacctttcggaattacgatcgccgcatagtattcgccggatttcaccccgtcgattgccttgtcgcttttcacgaattgccagtccagctggtcgttggcgtgcagtgtgctgatgatggtttcgcccacgttgacgcgcaccggtatgagatccgacttgtaacccttgtcgttattggccacggcgaccttcaatgccttggtgttgccgtaggggttccagctggccgcgatgttgaaccaggcgtacagcgccggtaccaccaccaggcccatcgagacgatcacggcgatcacgttgcgggtggcgtggcacatgtcccgcttgaagatgccccagattattttcactgttcgttcccctcctcacgcagactcctgccagcatttccgtccgtgtttccagccgcatactcagccgcatgttcaggcgcatgtccggccgaaccaccatgcgcagcctcatacagcctcgtgcgtacggcatgcatcggcttgtaatgcatgcccggccggaatagcaggttctcgtgcaggatcgcgctgcggaactcttccgcactcatcgcttcctcgcccagataattcgcataccgttcgcgcagatactccaccacgatgagatacgtgtcgatggcgatgatcgaaatgatccaaccgagcagcatggcgagcttcatgcgcgtgatgaatagcaacagcagaaacacgaacggcagtaccgccagcgcgaggaatccccagcgcaccaggcgcgggtacaggcggaagaaatgaatcgcccgtctgcgggcgagttcggggaactcctcggcgatctgctgcgcggtctcggtgagccgcaacggttccaccgtgccttcgttatgttcggtgatcatcagatcagtgtccgccagacggttgtcgaacaggcggttgaggttcaacgccagcttgcggacgaccaagccgatgaacagcgccacaggcagataccagaacagcgagagcatgtcgatccaataatggttggcatacatgccgccgatcggcccgcgcatcgcgttgatgccgtaggtgaacggtaggaacggtttcagacggcggaagaattccggcatcatctcgatggggtagaggcctgccgcgcccggaatctggatgatcaccagaatcacggcgacggccttgccgatatgccggaacgccacggcgagcgcgtaaatgatgttcacgtagacgaacgaggcgaaaatgccggcgaggatgaacaggaacggatgctcgcattggatgcccagcgcgagatcgccgatcgtggcgatgatcgcctgcaggaatccgaccgtgacgaacagcagccaacggcccatatagccttggcgtggcgtgtacatgcggatcttctcatcgcggtccacttcaagcttgtagatcgcgacgagcacgaatccgccgacccatagcgcaagattcgtgtagaacggcgtgaccgcggaaccatagtttttgaccgggtagaggacctgttcgtccaaatgcaccggctcgcccacgaacgagccgacctcgctcgcgtcaagtccgagcgcttgggaaagctgctggaacatcgccgaactgctcaacgcggccacatcggtgcgcgtggtgttgagctgtttggcgagattggcgagctgcgtctgcgtgccagcaatggtggtgttcgtttgggtcacggtgcgcgacaactggtcgagcagcccgttgccctgttccagtgtgctttgcagcgtggtaagcgtgccggacagcgacccattggccaggctgagtgtatcgagcccggtgttgagattcggcatgaccgtgccggtgatggtcgtgcgtgcgctcgccatcgacgccgtgccgtttttcgccagcgtggtgacatcgtcgttgaacccgttcgcggtgttcttccccgcgttgatcgcagccgtggtgtcctgatcgaaggcgtcgatgcgctgctgctggaacgtcagctgtttgcgggcttcggcgagttgcgcggaaagatccttatacgtttggctgttcggatccagctggctggcctgcaacgccttctccacgccgtcgagcacattgccggtggtggtgttgacgtgatgcatggtgctggacacttggtcgagcgcgtcctgcgtggtgttcagtccgctgagcacggtgccggtggcattgctcacgttgacctgcagaccggacagttgcgtgctgccgttgtcgagcgctccgaccagcgtgttcgagaatcgttcggtttgtgtgcgcgtctcgctcagcaagtcggacgccttgccgacggtgtcaagcgagttggtgattcccgaggcgagcgcgatgttggactgtttggccgaatcgatggtggtgagggccttgtcgagcgtggaacgcgtgccgcgcagctgctgttggacggtttcgagctggttgatggtgtcggtcagatcgttgatgacgtcgctttgcgcgcttttcatgctgccggtggtttctcccgctgcctccttcacttccttcgccacggcgtcggccacgctggaaacgaaagtggtgttgatctgctcgtcgatcgtggtcgcacccgtatcggtgattttcggcgcgatcgcgttcagcttttcgttgatgtagtacgtgatcgacggtcggtcgcctttaccagtgacggtgccgattagtctggagctgaagtcttccggcagtacgatcgccgcatagtatttgccggattccacgccttcgatggcttgctgctcgggaacgaaacgccagccgagctgatggttcttcttaagctggttgacggtttgctggccagcgtcgagatgaccgaccagcgtggaggttgtgcccttgtcctcgttcgccacagcgacctggatgttgcccgtgttcgcgtacgggtcccagttggcgaggatgttgcaccatgcgtacagtgatgggatgatggccacacccagcgtgacgacgagcgccactgggttcttcagaatgcgtttcacgtctcgaaggaagatggcgaaaacctggtgcatcaagtctcctcgcgggtattggtcgcaacatctacgtgcggcggcatgcccgtgcgggaatacccggttgggctcttcgtcgcgcgatccggtggatattctatgacttccgatggaacgatcgcaatggtttcgccctgtttaatggtcggtcccgcaaatgtcgggatatgagacgaaaacgctcggcatatggccctagtggggcgggcgacctggatatggagcggacggtcgggaaaacggaaaggaaagatggcgaatgttgtcacatgataagtgggatagggtcgggcgataatggaggcatgactattgcaacgccggaacgttatgcgcaaatgctggacgccgcacgccgcggcggttacgcctatcccgcgatcaatgtgaccagcacacagaccctgaacgccgcactccaaggtttcgccgaggcggaatccgatggcatcatccaggtctccgtaggcggcgccgcctacttctccgggcaacgcgtcaacgaccgcgtcaccggctcgcttgccttcgcagccttcgcgcacgaagtcgcggcgaaataccccaacatcaccatcgccctgcacaccgaccactgcgccaaacagtatctggacgaatgggtgcgccccctgctcgaccatgaagccgaacaggtgaagcacggtcaggaaccgaccttccagtcacacatgtgggacggttccacagtgccgctgggtgaaaacctcgacatcgcagaagaactgctcgacaaatcccaagccgcgcacaccgtgctggaaatcgaaatcggcgcggtcggcggcgaagaagacgggcacagcgccgaaatcaacgacaaactgtattccacgcccgcgcaaggcatcgccgtcgcgcaacgactcggccttggcgagcgcggacgctacatggccgccttcaccttcggcaacgtgcacggcgcatacaaaccgggcgtggtgaaactgcgccccgaactgctcgacgaaatccagaccacggtcgcgctcgcgattaaggccggcgaaatgcccgaccccgcgcactcgctggatgtcgctcccggtaagccgttcgccctggtgttccacggtggttccggctccgcgccggaggagatcgcgcaggccgtgagctacggcgtggtgaagatgaacatcgacaccgatacgcagtacgcattcagccgtgcggtggccggtcacatgttctccaactatgattcggtgctcaaaatcgatggcgaggtgggcaacaagaagatgtacgacccgcgttcgtgggggcgcgaagcggaaagcgccatggccgcacgcgtggtggaggcttgcaggcagcttggcagcgcgggcaaggcgttgaagtagtgtgatgccgcacgcgccgcgtaatgcatgcggcgtgtggcggcacggtgggtgtgtcgcgttgtatgagacgaaaacgatggaactgactagtttcaacggccgatcggtgcatatccggcagatatccggtagagggcgcaggatagtctttgtaaggccttggtaaggctttgaggcgaaatcgcatacgcgcggaggtgcaacaacatgcctggaattgttttgatcggtgcccagtggggagacgaaggcaagggtaaggcgaccgacctgatcggcacgaaggtcgactatgttgcccgcttcaacggcggcaacaatgcgggccataccgtggtggtcggcgacgaatcgtatgcgctgcacctgctgccctccggcatcatcagcccgaccgcgactccggttatcggcaacggtgttgttgttgatcctgaagtgcttttcgaagagatcgacggcttggaaagccgcggtgtggactgctcccgactgctggtgagtgagggtgcgcacattattgcgccgtatcatcgtgtgcttgataaggtgacggaacgtttcctgggtaagcacaagatcggtaccaccggtcgcggcattggacctgcgtatgccgacaagattaatcgcgtgggcatccgcgtgcacgacctgttcaatgctgagcatttgcacgacaaggttgaggcaagcctgcatcagaagaaccagatgctggtgaagctgtacaatcgtcgtccgattgatgtgaacgaaaccacggatgagctgcttcgtcttggcgagcgcctgaagccgtatgttgccaatacttcgctggtgttgaacaaggcgcttgatgagggtaagaccgtgctgttcgagggtggtcaggcgaccatgcttgatgtggatcacggcacatatccgtttgtcacgtcctccaacccgactgccggcggcgcatgcaccggtaccggtgtcggcccgaccaagatcacccgcgtgatcggcgtttccaaagcgtacgtgacccgcgtgggcgaaggaccgttcccgaccgagctgttcggcgaggagggcgaatggctgcgagcccagggccacgagtacggcgtgaccaccggccgtccgcgtcgttgtggctggttcgatgcggtcgtcaatcgttatgcggctcaggtcaacggcctgaccgacatcgtgctcaccaagctcgacgtgcttaccggcctgaaggaaatcccattgtgcgtggcctatgatgtcaacggcgaacgccgcgacgatatgcctactgatcagtccgaattcgcggcagcgaagccgatctacgaatccatgccgggttgggacgaggatatttcccaaatccacgacttcaatgatctgccgaagacctgtcaggattacgtcaagcgtcttgaggaactgtccggctgccgtatctccgtgatcggcaccggcccgcagcgcgaccatatcatccagatcaattcgctggtcgactgaccgtcggcaacgagtttcccggcttgactggcaacgacgcggcacatgatatccgccggctgattccgcgattcgaccacttgaagtggaagatggcggcggccggcatagtcattggtctggtttcaggattgctggtcgtcgtataccgtctcggcatcgaatacggcacggatgcgtcccgctggatatatgcgcggattcgcgagaccccgtggctgattgcgccgtgggcggttgccgcggtggcggccgcgctggcgatcgcgtggatggtcgtcaaggagccgatggccggtggcagcggcatcccgcagaccaacggcgtggtgatatgcggcttgaagatgcgttggcagacgattctgccagtccgtttcgtcggtggactgttgggcgcgttgtttggtctgtcgctcggccgtgaggggccgtccattcagattggtgcgtcgggagcgcagtgtgtgtcccaccgtttgcgcggccaccgccgtgaggacatgcaggagcattatctggtcaccgccggtgccgcggcaggcttgtccgccgcgttcagcgcgccgctgtccggcatgatgttcgctttggaaggggtgcatcggagtttttcccctgcgattctgatgggcgccactgccgcatcgctgaccgccgatttcgtctcgaaatactgtttcggtctgcgtccggttttggatttcggtgatatcggtcagctgtcgttggaagagtatgtgtggctgattccgttgggattggtggccggtttggttggttcgctgatgaaccgctcgttgcttggcttccagacgctgtacggcaaactgccggcatggagccgcccgatgattgcgattgcgatggacctgacccccgttaggtagacacctctgattccagccagtgtggttgggaaggaaggtaatctaccaccatgccccgcaaggtttacacggaacagttcaagcgcgacgccgtcgcgatgttcgagtcgaacccggatacctcaatgcgcaaggtcgcagaagaactcggaatcaatcgctcgactttgggatgctggtacaagcaattcggcactaacgtcgccaaggatgaagatgcagcgtcacccgtagaaaagcttgctgatgcggaaagaatccgccagctagaacgcgaaaacaaaaggcttcgtgaagagcgcgatattctgcgtaaggccgcgaagtattttgcggaagagacgacctggtgatccgcttccagttcgttgacgacaatctcgccgactactcggtcaagcggatgtgcacagtcctggggctaaatcggtcttcgtattacaagtggaagaactcggctccacggcgccgtgcgcgccttgtagatgacgctgtggtggccgcggagatccaggcaattttcgacgctgaaaacggcgtctggggcgctcgtcgcatcactgctgaactcaacgaccgcaagcgcgacaacggcactacacctccggctaagcgcatcaatcgcaagagagtggctcgtttgatgcgggcccagaacctgttcggatttcaaaagaagcgcagggtcaagaccactgcgcgtgacaaaggccggcgcgtgttcgcagacttggtgaaccgtgatttcacagcctgtgctgccaatcgtgtgttggttggcgatattacgtatctgccgatcgcagacggggcgaacatgtacttagcaacagtgattgattgcttttctcgcaagcttgtcggctttgctatcgcaaatcacatgcgtaccgaactggtagaagaggccctcgaaaacgcttcccacctgcgaggaggtcttgatggtgcgattttccactcggatcatggaagcgtgtatacctcgtcgcagttccaggcaacatgcaagcgcttgggcgttgcccagtcgatgggcgcggtgggaaccagcgcggataattcgctcgccgagtcgttcaacgcagctttaaagcgggaggtcctcaaagatgcgaagaccttcgccaatcaactgatctgccgcagagacgtcttccggtggtgcgtgcgctacaacacgtgccgtcggcacacttggtgcgggtaccaaactcccgatgagttcgagtcccaagccgcttaaggtctgataggcttacacctacttttgttcaccccacggtgtctactttccgggggtcgggcccgatcgcgttgcctgtcggcatctggttgcccgacgtgctcggcggcggctcgaatctgattgataccgccgaacatgcgcgcgtcggcttgggaatgctgtgtctgctgttcgtggcgaagatgctgttcacatccacgagtttcggctcaggtgcgcctggcggtattttcatgccgattcttgcggtcggttcgttggccggcggcatctgcggtgaagtgttgcatcgaatcggtgatctgccatccgacgcagtggcggtgtttgcggcgtgcgtgatgacgggcacgctcgccgcgtccgtgaaaacgccgatcacgtcgattctgttggctgtggagatgtccggaacgttgacgcacatgctgccggtcgctgccgtcgctttcatcgcgctgttggtgtccgatctgctgcgcaccaaaccgatctatggggagttgctggagcggtacgtgcgtgcgcaaggcatgcagatggcaatcgcaagccatgtgggcagcggcattatggaactgccattggaaatgggggcgattgcggacggcaagcgggtgcgtgacgtgcgttggccgtctgggtgtctgatcatcggcctgcgtcgcggcgaaagcgagatcgtgccgcgcggtgatacacggctgcgtgccggtgactatctggtggtgctgttcagtggcgaggaggagcgcgaggtacgacctgcgatgcggcggctgtgtgatgcccggcttgactgagcctggctgaattcggctggactctggatgtccgaatctgcggaatcggacatccagggtgcatacgttggcgctccgtgtaaactcatatgcgttaggaaggcggcaaccgcggcccagctcgttgttgcacggcctatgggcggaacaacgctgtccgcgggaggccagtacagggggagcgcaatggaatcgcaagaacaatcgccgggagacgtggtgactgcgggtgaggactcgcatcccatcacgcaggcaatcgacactgttgaggtgacgcatgctggtgcaaccacgcccgccgctaacaccatggatccgcctacgattcccctggcaccgatgaaacgtatgcaggcgcggttcaatccgctcgccgacggactgatgtatgttgtggtgttcgtcggtggatttgttggagtcggctgtcggcatgcgttggatatgcttctgccgtcggtcagcgggacgccgttcgttgtgggcacgtttgtgtcgaatatggtcgcctgcttcctgttcgcgatgctgaccgaattcatggcgaccgcttcgtggctgcgtcgccgggtgcggcaggttgtcagccgtggtgttgggcttggcttgctcggtgggctttcgacgatgtccggcgtgatgctggaaacgatggaaggtctgcacgagcggcatatcgccagtgcgcttggctatcttgcgggaaattttgcaggcggtttgctcactgccgccgccggcgtggttctgatgcaggcactgctgtcacggagtactcgaaagcgggttcagggtgcgttttcagctgtttccgtgtccgattctgccgaatcggtcacgcagggcgtacgccatgtgaaagtggccgacgtggcgcgttctgccgcgcaggccgcaatggaagccgcgcaggcggcgcagcaggccgcgcaggcggcccagcagattgcacagacgggacaggttccgcgagtcgaaacaccaaccgtgccgccgaccgccagccagactatgcagacgggccgcgttccgcagattcctccgctggccgttcctcagctggcacagccatcgcagccgttgctgcgcgagcaggatacttcagacttggggcagctgcccgagccgattcagcagtcgcaaccaatccagcagccccagcagcagtcgcagccgatccagcagccccagcagcagtcgcagccgatccagcagccggctaacccgcttccgcccagcttcgagcccaaaccgatcactgcggagatttcgcttatcgccgacccggctaccggggaggtgcgctgatgatgtggatgatctgtctgttcggcggtctgggcgccatggcccgttacgtgctcgacgtgtcaattcaacgaggctggaatcgcgagaatcggagaacgaaccgcaacttcccgctatccacgctcgtcatcaacggcgtcgcctcgctatgcgcgggcatcgccatgatgtcctactattcgcaatcggtggatatggacacggtcatgatgttcgttgtcggatttctcggtggtttctcaacattctccacggcgctcaacgaagtggtttcattgattcgccagcgtcgttttacgctggctctgggctatggaatagcaaccgtcgcggtgcctctcatttgcgtggccaccggtttcggcattgcgctgctcgccaatccggcgtaattttcacgttacgcggacggtcgctgagtaacatgaaagaaatctgagcgcaaccgccatcaaggccgccagcccggatgcgacgctggtgattgcattcgaccaggccaagccgctgctgaaggatggcaaggatatccagtaccagggccagaccggtatcggaccgttcaataagaacaatgatccgagctccgcgaacatcggcgtctacaccttcgacaaagacaacaagccggtcttcgaccacacccagtccggcgacgtgccgaccgactgatcgcaatgtaggtcatcatcaatacaagaagacggcgcaaagtgagtgtggatgtcgcaagctttgcgccgtttcttttgttgtgctgtgctgccgttttccgtgtcgtgggcagcatacgaaaatcaatattgaaaatcaagtaaaggggtaaccccgttaagtgatatacacgccggactgtcgaacaggttcgagagaatgtaaatgaatgtaatatctcgcgagaagcgcacggaaagcgcgcggcaagcacgtgagaatacaacgatggaacagtgataacggggaaggtgcgatcatggtcggcatgcgcgatgtggcgaagaaggccggggtgtctctgagcaccgtctcgctggtggtgaacggcaacgggtatgtatccaacgacatgcgcgaccgcgtgcgtaaggccatgcaggccctcaattacgtgccgaacgagcttgcccgcaacctgtaccacgatcgcacgaatctggtcggcgtcatcgtgcccaccatccgtcacccgttctttgcaacgtttaccgcgcacctgcagcatgcgctcgccgcgcaggggctgcgcaccatgctgtgctccaccaccgacgagacggacggcgaaatccaatacgtcgatatgctgcgcaggcacatgatggacggcatcgtcatgtgcgctcacacctcgcatcccggcgattattggacgtccatccaccgcccgatcgtcgcattcgatcgcgtgcttggaaatggtatttcgtcgatcggatctgaccacgagcagggtgggcgactgattgcgcagatgctgattcgcaatggcgcgcgccatgtggtgatgattggcggtccgcgcgatcagttcttcgatctggcggtccgcggcgaagtcgaggaggggtcgttcgatttgggaaagaccacgttcccgacggtgcgctactacctcacgttggaacaggaattgacctccgcgggcgtgaagtatgagtatatcgaggccggtgaggtgatggatttcgccggctatcatcgtgcggtcagccgtgcgcttgatggggtggcgaccgacggcgtcgatgccgtggtcagctccgatattggcgcggcgttctgcgtgcgtgaggcgttgagccgcggaatttccattcccgacgagctgcaggtcgtcgcctatgatggtacgtatttgaccgatttggccggtatgaagctgaccgcggtcgcacaggatttctcggcgatcgcgcagtcggcggccgaccatatggtgcaggcgatcgccaatgaagaggcggctgcggccaacgcctcgcgcaagaacatccccaagccgttcgagccgaacgtgcttattcccatgacgctggtgccaggcgataccacgcgttgatgctgcgcgttggaacgctgggttggggtcggacagtctgggctgcatagaacaccgcatcaaaccggttcgacacgcgcattccgctgtgtgactggacattgacgcccttttcgaggtaatatcgaaccggttcgatacatacgtgagtatgcaaatacgtaaacaacaaacaggcagacgcgcacacattgcacccgcacccatgaaccaagggaggtcccatgaaaaacaaagtgcagctcatcacctacgccgatcgcctcggcgacggcaccctcagctcgatgaccgacatcctgcgcacccgtttcgacggcgtgtatgacggcgtgcatatcctgccgttcttcactccattcgacggcgcggatgcaggcttcgaccccatcgaccacaccaaggtcgacccgcgcctcggcggctgggacgatgtcgccgaactttccaagacccacggcatcatggtcgacgccatcgtcaaccacatgagctgggaatccaagcagttccaagacgtgcttgaaaagggcgaggaatccgagtattacccgatgttcctgaccatgagttccgtctttccgaacggcgcgaccgaagaggatctggccggcatctaccgtccgcgcccgggtctgccgttcacccactacaagttcgcgggcaagactcgcctggtctgggtcagcttcaccccgcagcaggtcgatatcgacacggattccgacaaaggctgggaatacctgatgtcgattttcgaccagatggccgcatcccacgtcagctacattcgtcttgacgccgtcggctacggtgccaaggaagccggtaccagctgcttcatgacgccgaaaacgttcaagctcatctcccgcctgcgcgaggagggcgtcaagcgcggcttggaaatcctcatcgaagtgcattcctactacaagaagcaggtcgagatcgcgtcgaaggtcgatcgcgtctacgatttcgcccttccgccgctgctgctgcattcgctgaataccggtcatgtcgagccggtcgcgcattggaccgacatccgtccgaacaatgccgtcaccgtacttgacacgcatgatggcatcggcgtgatcgacatcggttccgatcagctggaccgttcgctcaaggggctcgtgccggatgaggatgtcgacaatctcgtcaacgccattcatgcgaacactcacggcgaatcgcaggccgctaccggtgccgccgcatccaatcttgacctgtatcaggtcaacagcacctactattcggcgctgggatgcaacgatcagcactatattgcggctcgcgcggtgcagttcttcctgccgggcgttccgcaggtctactatgtcggcgcgcttgccggcaagaacgacatggagctgctgcgcaagaccaacaatggccgcgatatcaatcgccattactattccacggctgagatcgacgagaatctgcagcgtccggtggtgaaggcactgaacgcgcttgccaagttccgcaacgagcttgatgcgttcgacggcaccttctcgtacagcgccgacggcgatacgtccatcagcttcacgtgggagggcacgaccactcaggccacgctcacgtttgagccgggccgtggtcttggtgcggagaacaccgcgtccgtcgccacgctcgaatggcgtgatgccgccggtgagcaccgcacggacgatctgatcgccaatccgccggtcgtggcctgattcagcctcgcctgatccggtcgctgcctgaccgcgcataaatccataaatctgtaatcgtccttcctgtcacctctccttcaggaaggacgattcgcattttcgttttttcgagcaatcgtcttatcgggaaaacaattttcccgggaatcagctgaaatcccagcaaaaacgggtaaggtgagcttatgtcaaagatgtcaaagcttttcgatcaagacaacatgtttttcgccattatgggcgtgctgttcgatctgattattctcaacgtgctcacgctgttgtgctgtatgcgcggtttttcatctatatgattccgctgctggttttgatgggcgctacgttgccgcaatattgttgcgcatgagactcacacaaccggttcggatgcgaagcgataatcgcatccgggcttttcttatgcgatatcgattcttatgcgatatcgatattgagattgcctcgcatgtttctgctgtctgacaggacgtattgatatggttgatttcgccgaaagaatcgctcgaatgcactggtgcagtgcgtccgggcgattttcatatgtgctgaatatcgtgtgacatttcgaaacgagcaacgaaatagaagcaagaacgagaagcgacaatacaaaacaggaaaaacaggaatagaaacaagagatgactgaagataatcaacataatgcaggtgagcagcagactccaatgcagccgcaaccgctgccgggccaggtgttcgtacgccccggtatcgatgaccgtcccgattacgaaaaaacgctgaccgaagagaccaaagcggccctgaagcgcttggccgtacagcagaatccgcgcgtgcccgaggcttccaacgagcgcccggaagtgcagcagacccgcatcaacacggaaggcggctccccgctgaccgcgttcgcccatctcgacgccgctgtgccgaacctcgaatcgtcgttccttgacctgcgcgatccgatgaccgcgcccgacggcaccacgcccaccaaaccgcaggtgcatcgtctcaccgccggcttcgcgcttggtgcgctgctgttcaccgcgccgatggccgcgctcaactctgtgctcattccgcagaccatcagccgtctttccggcaccgaccgcgtcaccgatctggcgctgctcagcgtcgtcggcacgctgttgacgttcctgatgaacgcgtggatttccgtcggatccgaccattcgtactgcccgctgggccgccgcaccccgtggatcatcgccggcacggtgctgaccgccacgtcggtggcgattctttccgcatgcgatttcatgccgttggtcatcgtgttctggctgtttacgctgatcggacatgcgatggtatcgatgccgctggcggccgctttcggtgagcgcgtgcctgacaagttccgtgatcgtgcggacgcgtggcgtggcgttggccaagcgttcggccaggtgttgggcattatcgcggccgtttcgattacgtgggctgccgacgattccggttgggatggcaccacgcgtttcgccatgatggtgtttgcgttgtgcctggtgatggctggtgtggctacgttgctggtgttgccatttgagggttccagcagctatttgcctcgtgagggtgtgaagaagggcgattatttttcgcagtatcgtccgccgaagggcgctccgaagttcttcattgcgtttgccgcgcgcatgtttgccatcgcagccacttccggcattgcgatttaccagtggtatcttgcgcaggatggtttgggcgatgtttcgcaggtcaccatgtttggtttgtccggagcggctgcggttatgtcgatgatggccgttgccgcgttcgtcggctcgctgttggctgcgctgctgcttggccgcatcgcccgcgctttcaaagattcccgtattcccgcgattgccgcctgcttgttgtttgtggttgctgtggtgcttccgttgacgccgatcgatagtgctatggcggtcgcgctgtatgcgctgtttgcaggtttcgcgtatgtggtgtatgacggcgtgagccaagggttgaatcttgcgacgttgccggatatacgttccgttggtcgttcgttggctgcgttcagtttggcgaatacgttcggttcgttgattggcgctgtcgtttgcgcgattgcgattgcggcgactggcgagtatctgctgattttcgctgttgccgccggttgcatggctgttgcgggcgtgctgacgttgctgctgaaatgatttggatgacctgagataatccgaaaaacgaatatcaaattcaaaattgcgcgtccacatagtgaacctttagtagaaaggatatgtggacgcgcttatctttacggcttagttcgagcggacaatccgccgaatacaagactttgcgaaaggaggttcgccacgatgaacggaatggttgcacgcgtactgctgtccgcacgaattattattccgctttcgttggcggactgattcgagcaatgcagcttcaatccctcgccaacggaggcagggtttgaggcgcgcaaaacacacacgttgatggccctgcatgctgcggggcctttttgttgccgcccacaaggcgtaaggcaacgaaatgaagactgcacacaagagaaatagaagaaagacgttatcggcgcatgttgggagccggtaacgcatgacagacgtaacaggagtaatccaatgagtgcagtcgaagcagccgctggtaaagcgcaggcaatggtgcgcgattcggtgaaaaccgtgatcgccgcttccatggtcggcaccgccatcgagttctacgacttctacgcatacggcaccgccgctgcgaactatttcccgaaggtgttcttcggagacaccaccaatccgaccgtcgcactgctggccagcctgctgaccttcgccatcgcgttcatcgcacgcccgctcggatccttggtgttcggccatttcggcgaccgcatgggccgcaagaccacgctggtggtttcgctgttgaccatgggcatcgccacgttcctgatcggctgcctgccgacttacagccagtggggcattgtggctgtcgtcgcgctgtgcctgtgccgtttcgtgcagggcatcggtctgggcggcgaatggtcgggtgccgctttggtggccaccgagaacgctccggaagacaagcgcgcgctgtatggctccttcccggaattgggcgctccgatcggtttcttcctgtcgaacggtacctacttcctgttggaaacgttcaacgatgacgatgcgatgctggcatggggctggcgtgtgccgttcctgctgtccgcagtgctggtgatcgtcggtcttgtggtgcgagtgcagatggaggagactccgatcttccgcatggcccaggagcagaagaaggtcgtcaagtccccgttgaccgaagtgttcaagaagagctggaaggaagtcatccaagccacgttcctggtggccgtcacctacacgctgttctacacgctggcaacctggtccctcgcttggggcaccaaaaccgtcgagcagggcggcggagaccttggtttcaccaatcgtgaatacctgctcatgctgatgcttgccatctgcgtgttcgccgcgttcatcgtcatttcctgcgtgaacgccgataaattcggccgcaagcgcgtgatcgtcatctcgtcctgctgcctcgtggcattcgcgctgctcttcccgttcctgcttgatccgtcggtcgtcggccagcgtaacttcgccgccaacctgctgttcctatgcatcggcttcgcgttgatgggcaccgcattcggtccgatcggcgcgttcctgccggagctgttcgacgccaacgtgcgttattccggctccggcatcggctacaacctggccgccatcgtcggcgcggcattcgtgccgaccatcgccacttggctgtcccaccactggggtgtgcactccgtcggtctgtacctcggcgtgatggccgtgtgctgccttgttgcggtgctgagctgcaaggagactaaggatgttgatttcaccaagtgatcaatcgccaagtgccgtttgaccggctattcagcgacgtgtcaagatgacatcgacggaagccttactaaaaacgtttgacgcgaatataaccactatgtgaacgtcagcaagcaacataaagaaagcgggactaaaacagttccgcaggagaggcggggtggttcctcggacacaatccgggggagtaatctcctaggaaccatcgcccgctgtgaacaaccgaaacaagaattaaatatcgcgagtttgttcgggaatgcaagtcccgaatcgctataaaaagaaaaataaaggagcgcctattatggcagcaactatctggtacgagaaggacgccgatctgtccgtgttcgatggcaagaaggtggccatcctcggttacggttcccagggtcacgcccacgcgctgaacctgcgcgattccggtgtggatgtcgtcgtcggcctgcgtcctacctctaagtccgtggaatacgccaaggagcagggcctcgaggtcaagcctgttgccgaggccgttgccgaagccgacgttgtgatgatcctgctgcctgaccagtaccaggccgccgtgtacaagaaggacgttgagccgaacctgaagccgggcgctgctctggctttcgcccacggcttcaacatccactacggctacatcaagccgtccgaggatcacccggtgttcatggtcgccccgaagggcccgggccacatcgttcgtcgtgagtacgccgccggccgtggcgtcccggtcgtcgttgccgtcgagcaggacccggacggcaagacctggccgctgtgcctggcttacgccaaggctctgggtgctctgcgcgcaggcgccatcaagaccaccttcaccgaggagaccgaaaccgatctgttcggcgagcaggacgtgctcatgggtggcatcaaccacctgtgcgatatgggcttcgatgtgctgaccgaggctggctaccagcctgagatcgcttacttcgaggtgttccacgagctgaagatgctggtggatctggccaacgagggtggtctgaacaaggctcgctggagctgctccgacaccgctcagtacggcgattacacctccaccgtcatcaccgaggagaccaagaagcgcatgcagtaccagctcaagcgcatccaggacggctccttcgccaaggagttcatggatgatcaggccgctggcgctccgaagttcaaggagctgcaggaagagtacagccacccgcacctggagaccgttggtccgaagctgcgcgccatgttctcttggaacaaccagacggacgccgatgccgatatggccgagtccttcaacggcaagatcgctcgtacccaggttcagtgatttcgctgtagcggctgcatgttaagggccgctgaataacgtagtagcgcaatatgcgcgaaacgtgttggaagccaccgtctcaccgcggtggcttctttttgttgctgtgttgttttatgactgggatatttcgtatgcgggatcgcagtactgattgtcgggggagccgcacggctaggcgttggcccactttgtggactcaatgcttatttaggaagggacgggagtaggatagaccccagtttgcaggacaaaatccatgcacaaaaacacgcgaattcatctgcgaatggtagaaacccgagcgccgggaggcgttcaccccactacataaaaaggagtgccaagtacaatggctgcacaaatctggtacgagaacgacggcgatctctcggtcctcgaaggtaagaaggttgccatcatcggttacggttcccagggtcacgctcatgcgttgaacctgcgcgattccggtgtggacgtcgtcgttggcctgcgtccgacctccaagtccgtcgagcacgccaaggagcagggcctggaagtcaagtccgttccggaagctgctgctgaggccgatatcatcatgattctggctccggatcagtaccagcgcaccatctgggccaatgacatcgagccgaacatcaagccgggcgcagctgttgctttcgctcacggcttcaacatccactacggctacatcaagccgtccgaggaccacccgatcttcatggtcgccccgaagggcccgggccacatcgtgcgtcgtgagtacgccaacggccgtggcgttccggtcgtcgtggccgtggagcaggatccgcgcggcgacgcttgggacatcaccctggcttacgccaaggctctgggcgctctgcgtgcaggcgccatcaagaccaccttcaccgaggagaccgaaaccgatctgttcggcgagcagaatgtgctcatgggcggcgtgaacaagcttgttgaaatgggcttcgaggtcctcaccgacgccggctaccagcctgaaatcgcctacttcgaggtctgccacgagttgaagatgctcgtcgacctcatgaacgagggcggtctgaacaaggctcgctggtcctgctccgacaccgcccagtacggcgactacaccaacacctgcatcgacgagcacgtgcgtgagcgcatgcagtaccacctgcagcgcatccaggacggctccttcgccaaggagttcatcgaggaccaggacgctggcgctccgaagttcaaggctctgcaggaagagtacggcaacgtccgcatcgagaccgtcggcccgaagctgcgcgccatgttctcctggaacaacggcaaggatgacgacgctgatatggccaccttcaccggcaagatcgcccgtggctgatgtggctcattcggctaatcgctgagtcttttacaagaccgctgcccttacgggtggcggtcttttttgtatgttctgtcgcatattgttctaggatagatatgtacggtttcttacggtttttctataggaagagatgtcatggtcactgcgactggtcccgcacctggttctgaaatgacaacgtcggctgaacctaccgaagaccgtagcacgtcaggagttctgcacgtcgccgcgattttcgcctcgcatatggtgttgcagcgtaacaagcccatcgccgtgttcggcgcgcttgatgccgattgcgccggacttgaggtttccgcggaaatccgcgatttcgatggttccgtgatcgtgcaggcgcatgcgtacgcctccaaagagatcaagaacggtttttcaccgtggcgcgtcatgctgccggcacagcccgaaggtggcccttacacgttgcgcgtcaccgcaggcaacgatttcatcgaatattatgacgtgcttatcggcgaagtatggctggccggcggtcaaagcaatatggaacttgaattgcgcaacagtgaagacgccgaggaagccctcgataactgtgccgatccgttactgcgcttctacaatgtgccgaaaaccggtgtgatcaatcgcaacgccgaacatgcggcaagctggcaggaatcatcgcctgaaaatagtggcgtaatgagtgcggtagcgtactattttgcgcgaaaactgcgtgatgaacttgattccgaccttccgatcggcattatcgactgttatatcgggggtacgtcgatcagttgctggacgagcgaagatgcactgaattccagcgaatccgggcgcggctatcttgcgcgctatgagcaggcgatcgcaggtaaaacgcaggaacagttcgatttggagtacggcgaatggcagtcgcgttctgatacgtggaatgcgtcgatcgcagccgcccgcgaagacgatcctgatgtgacgtgggatacgctgacccaacagtatggcgaatgcccgtggccgccgccgatgacgccgacctcgcagtggcgtccgtcaggcgcgttccatgccatgctggagcgcattgtgccttactccttggcgggattcctatggtatcagggcgaggaagacgagccgtattgcggatcctaccgtgagttgctgggcatgatgattggtgaatggcgtgcgctgtggagcgaaagcctgccgttcctgatcgtgcaattgccgcagtggattgacaagaaggtcgacgagggcgacggcgatccgatgctgtggccggtgttgcgcgaggcccagtgggatgccgcgcagtccatcgacaatgtgttcgccatctgcactatggattgcggcgaatacaacaacattcatccggttgataaacgtacaccgggcgagcgtctaggcaattgtgcgcttcgccaagtgtatggtatgagccgtattccggtgtatgggccgactgtgctgggtttccgctgcgacgaaggcggccgcgtacgcctgttcttccggtacgcgcacggcctgcatttcagtggcaccacgcctgacagttttggtgacgagttcgccaagagcctgccttcgctggtgcgtctgccggaacgttccggtttcgagcttgccggtgccgatggtgtgttccatccggcctacgccgcgattttcgtggattgcgatattgacgatctggtcaacgcaaaggtcaacgtggtcgattacaacgccacggaattcggtattccgatcaacagccgcagtatcggcacgattacgttggccacgccggaagtgccagcgccggtgatgatgcgctacgcatggcgtagctggggtccggcaccgttgtttaatgacaataatctgcctgctcacccattcaagctggacctgaccgatcacaccgactctgatcacgctgaataatcacgttagatagttgcgttgaacggctgcgtcacatgattgtcgatagttgacgatgaatagcgtgcgattgctgtgcttatagtgtgctgcaatcgcacgctttatattgcgattgaagtcctgctgatcgcacgtcagtcaaatacgaatcaaataccagtcaaataaaaaatcgttgaaaaatcaacgtttctgcgatttatgccaccaaaatcgcagaaacgaatcaaataaaatgcgctgcactgcgagcgcataggctattgccagaggtccgggccgaatgattccaggtatgcggtcagttcggcggccatctgttcgtcttccggaacgcgcggatggccatccgtgccgcaaccattgcgtgaatacaagaaatgttttacgtgaaactcgccctcagtgccgcggccgttgccgtggaagatggcgtggaacttaccgccacagccaagagctacgtgcgcgacctgttctgcatggcagataaggtcgacgcgaaggcttcggtggccgagggcatggtctcgctgcttccgggcgaaagcgtcgtgctgcatatcgccactgccgatgccgcagcgcttgccgctccgggtgcgttcgcagccgccaacgtgccgcgttccgccaacgatccgaagcgcgaatggtgagcttccgcgagtacgccgtctactgaagcggtagaagagtggatagaggactactgaaatttcagttgacgtgttcggttgagtaaaaacataagttgaagcgccgccaaccttaagaaacgaaagtgttgtgaacgttgacttttcaagaggttggtcggcgcttttactgtacgatgtagatgaaccgtttaagttgcgatttaagttaagaagaaggacacggacatgcctattcaaaaaagcaaggtgacgatttttgacgttgccaaggcttcgggagtctctagtagcgccgtttcgtatgcgctcaacggcaagtctggtgtttccgatgtgactcgagacaaagtgttgaaggtcgcacacgaactgggatggaagccgaatggcgcggcacaggcgctggccaaggcgaagacgcagcgcgtgggtctagtgctgggttacgacccgaagctgctttccgtcgaatcctacatgatggaacttatttccggtcttggcgccgagctggaaaaatacgattattctctgctggtacgcatggccgtgggtgaggacgcgaagctttcgatcatcgatgattggattgctactggcaacgtcgacgccatgctgctcgtcaatgtcgagcttggagacccttgcgttgccttgcttgaggagcatgaggagatgccggtgcttgccattgccgatgcctccgtggtcggcaatctgccgagtctgtcaagcgccgacgccgatgccgtgcgccgagcggtgcgatacctgtatgatctcgggcatcgtcagatcgcccgcgtcggcggtcccgaatcgcttgcgcactcgtatattcgcgattccgcctttgcggacgtcgcttccgagctgggcatgcgttatcgttgcctgcacaccgactacacgccggaaaccggtcgcgaggccacgaagcgcctgctggcgttctctgagcatccgacggcgatcatctacgacaatgatgtgatggcgttggctggccttggcgtggcagcttcgcaaggcatcaaagtaccggaggaaatctccatcatgtcgtgggatgattccctcatgtgcaccgcggcgtatccgaacctgaccgccatgggccgtgacgtggtcgataccggtaagcaggccgccggattgctgctcaagctgatcggcggcgagcgtgtggggcatctgatggaagggccgtacgaattgcgtgcccgcgcttcgaccggtcccgctccggcagcggaataagatgcgatgatgagttaatgcgatgatgaattaaaaaattgcgattgcgcatttgctgcgccccgacaagggcaggatgaaagcgagcagcgagccgatcgcggcgatcgccgcaagggttacgccatacaggattgcgacggtgttgccggactgcttcgacaggtaccacaggtcgaacggcgcgagtccccagaacagcccgggaatcgcggattggaaatcaaaatctgaaatctgaaatcgtaatctgaaatcaaaaagcgcccgtgcccctcgcttgaggcatgggcgcattgttgccttacgacttcaggcgcgcttctgtgtgatctgataggcggcgaacagcacgaccagccaaatcacgccggcgaccactgcgatgcgatagcttgcggagaagcacatcagcaccacgaccagcagcatgaacgcgatcaccacatacggcgtcaccttggcgaacggcagcttgaacgcaagtttgtcaagtgcttcctggcccttcaatcccttcaaatcattcggaccgtcgccggcggcgacaacgcgacggaacttaatttccgtaatcatgatcatgatccaattaatcgcagcggcaatcgtggcaatcgacatcaaataattgaacgcgaaatcaggccacacgaacaccaccaccacggcgatcgcaatgatgatggccgacgtgatcacacccccgaccggaacgccgcgcttgttcaggcggcccagatacgcgggcgcattgccctgcttcgccaacgaatacagcatgcgcgagttcgcgtacaggccggagttgtacacgctcatcacggcggtcaagcatacgaaattcagaatgccggcggctgcatgcacgcccaccgagtcgaaaatctgcacgaacgggctggaattgccgtcgatcgtgctccacggcaccacggccataatcacgccgagcgcgcagatatagaacacgagaatacgccagataatgccgttcgtggccttcgggatggtggtgcgcggattttcggtttcgcccgcggtgatgccgatgagctcggtgccgccgaagctgaacatcaccacgaccagcgccatcagcaggccggtccacgtgccgtccgcattgcgagacatcaggccatgcggcaggaatccgccgtcaacggtaaaccagttggcgaacgacgcgcgaatgcccgaagcggtcggcacattcgcgatgatcacatacaaaccgccgaaaatcatggcaagcacggccacgatcttgatgatggcgaaccagaattcaaattcgccgaacttgttcacgcccataagattcagcgccgcgatggccaccaggaacaccgccgccgacacccacttcggaatgttcgggaaccagtaattcacgaacgagccaaccacggccaactccaccatggccacgagcacgtagttgaaccagtaattccagccggaaataaagccggctcgcttcgaccagtactgcgtggcgtaatagctgaacgcgcccgccttcggatcctcgaccgccatttcggacagggcgcgcacgatcaggaaaatcgccagaccgccgatcagataggcgagcagaatggccgggcccgccagctgaatcgactcgctggaaccatagaacaggccggtgccgatcgcgccgcccaatgcgatcaattgaatatgacgattcttcaaagacttgcgcagcgtcggcggaaccggcacatcgtcggtttcgcgcggtttcttcgcaacggttgcgtcgctcatgaatgcttcctcttcttgggtgcctcggcaatattcggcaaattcggcaaaagtttgcgatcttggcgatgttgcgttcggcagtagtggtaggtgacgcgcctatggtttttggtatggcgcgtcttccccgattgtagctgtagcgcgtggattcggtttcatagtgttcaatagttcgatagttcaataaaatgaaggttttgggagcaatggttggtgctgcttgagcgctacgggctggaggtcgtcatggcattcatcaaagacatggtgcgtatgtggttgcatgcgtggaagcgattcatctccatcgcactgatctcgttgctgggcgttgccgtgcttacgggcatttacgcgggttgccgagacgcttttcttgcgacggatcgttttttcgacacccaaggattgcacgatattcaggtgttgtcgacggtcggattgaccgatgacgatattgccgcgctccgtaaggtttccggtgtcgcgaaagtgcagggcgaacgttcgcaaaccgtgacggtcgatctgaacggcaaaaaaaccgtgaccatgcaggagatcggcacgaacggcattgaccagccgtatttgcaaagtggccgtatgcctgaaaagtccggtgagatcgcggtgacgcgcaaattcatcaaggattccggatataaaaagggcgaccatattacggtgacaccgcaggattcggcgtcttcttctgtgtccgattctgcagaatcggacacgcaggatggcaaacgtgccgcacgggtgaccgattctggtgaatcggacaatcaggcaccgagctttcccaccgaactgactattgtgggcgtggtgcttgacccgcaggatctcaccaatccagacggctattcgggtacgaacgcgttccgttcctccgccaccagcgactacacgttctttgcgccgtccgacggtgtgaccggcagcatgtacacggccgtcaccattctcgtgaaaggcgccgccgacaaggactcgttcagtgacgtgtacgacgacaccgtcagcgaagtagctgaccgcatcgacggcacggtgcgaaccaatcgccagaaagcgcgtcatcaggaactactcgacgctggaaccaaacaaatcgacgaggcgaaagcgcaaaccgacaaacagttcgccgcagcgcaacagcagatcgacagcaatcgcagccagctcaatcagcaaatcgaccaaatcgtcaatatgcaggcgggcgcggctgcaggatccctcgacgaaacaacccgtgaaacactacgtgaaacggtaattgccgcaagcccgcaattagcggaagccaaagcgcaactcgaccaggcgcaatcgaaattggaccagcagaaaaaagacaccgaacggacactgcaatccaagcaaaacgagctggaagacagcattccgcaagtgcgttggtatgtgcaggaccggtcgcaaatcggcggattcagctcgctgaaatctgatctggaatccatccaatcgctgggcaacgcattcccgatcgtgttcttgctcgtggcggtgatgatgagtctgaccgccatggcgcgcatggtcgaagaggatcgcgggctgatcggcacatacacagggctcggctacgggcgtcttgcggtcgcctcacgatacctgttgttcgcgctgttcgcctgcctgatcggcggtggactcggcctgatcgcaggcttccttggcattccggcgttcctgctcgtcgtattgcgaggcttgtatgtgatgccggacgtacgcttggcatacgactggctgtacggaacggccggagtcgcgctgttcgtggtcggcgtgcttgccgcaaccgtgtatgcgtgcgcgcaggaaatgcgacagaagccggccagtctcatgcgtccgaaagcgccgcgtgcaggatcgcgcattctactggagcgtatcaagccgttgtggaatcgcatgagcttcctcggcaaagtcacggcgcgcaacattttccgtttcaaatcgcgtctgatcatgacggtcggcggcgtggccggctgcaccgcgctgattgtgtgcggacttgcgatcaacgacaccgttgccgcattgggcgcgaaacagtatcaggacgtgtatcagtacgatttgatggtggtcgcgaacgatgatgacgctgatgcgatgcggcagaaagtcgcttcggatggtcgcgtcacgtcgagcatggacgtgcgcgttgaatcgggtgatttgaccggcgattcggggagcgaaagcattcagctggttgccgtgcccgacagtgaacgcagcgagttcggcaagatggtcacgttgcagccggtgcgctccagttgggtggatggtgcggccgatacggtaagtctgggcgatgacggcgtgatcgtatcgcagtccgcggcaagcgcgatgggcgtcaaagcgggcggtatggtaacgctgaccaacggtgacgatatgcaggccgaagcgcatgtcagcgcggtgatccgcagtgtgatcggatcggacgtgtatgtgagcgaaacctattatcgccagctgttcgatactgctgcatccggtacctcgaatggcgcatcgtcaaacggccaacaattggtgtggaacgccatgtatgcgaagctcaaaggttcaggcgaatcccaggccgcctatgcggaaaagctggaagacgacgatgcggtcatgaaagccgtgagctgcgcgcacatggcggaaagcttcaaattcgacctgatgggcgcggtggtcgcgctgatagtggcgctcgcgggcgggctcgcgctcgtggtgttgttcacgctcgccaacaccaacgtgtcagaacgtgaacgcgagatggccacgctcaaggtgctcggattcttcgacaaagaggttcaccactatgtgaaccgtgaaatgatggtgctcaccatgatgggcgtggtgctgggcttgccgctcggacgtttcgtcggcggattgctgacggccgcgttgaacatgcccgcactgtatttcgaagtggaatgcaagccgttgagctatgtgattgcggccggcgcgaccatggctttcgcgctgctcgtgcagttgttcgtgaatccggtgttggatcgtatcgacccgattagttcgctcaaatccgtcgaataggcgcatgtctgaatgtccgattctccagaatcggacattcagacgggtaaaagtgcgttacggttgtccgtttctccagaatcggacacttagagtgccggaaaggctcggattcgcgtttcagttcttcggataacggtagttgtgtggcagttgcgtggtgagctgcgggtccaggccgagttccttcaactgccggtcgatttcgcggcgcgcacgtttcacaagttcggctcgatattcatcgtcatgtccggcattgctatgtgccgcatcgccatgtcccatcgttcccatcttctccagtgcgtccaatgtttccgccatacgcttgagccggtcctgatggtgcagcagcgcacgcacctgcgcatgttcgtgcacgatcgtccgccaatcggatggtgtgtgtgcaatctcccgaaccgcggtgaccggatgtacgtcggccacctgatatgtgatcgagccaagcagcggcattaggaacaccgtaatcgcgccggctgcgaccagtgttgacgcggtgtcgccttgcatggtgccgaccttcaccgccagtgacgtgacggcgacgatgatcggcagcgcggtcgtgcaatacagcgctacggtgacgcgatgatgcgatgacagcggattctcgcgtttgtcgagcgatagcgcaacatatacgggcaccgcgcgaatcagcatgagcattacgatgaacgcgacgagcagcgcgggtcggcctgccacggcgcgcacgttgatcgcggctcctgacaccacgaaaaacacaggaataaggaatccgtagccgacgccttccagcttcatttccagcgacttgctgccgtcggggatgatgtaacgcaggatgaagcctgcggcgaacgcgccgagcaccgcgtcaagttcgaacagtgcagaaatggtgacaaggaagatgagcaggaatgtggtcagtcgcatgagcgtttgcgatgacgtgttcgcgttttccgtaaggaagcggtacaggcgatggccggttttcagtgctttcgtgggtagcattgcgcacagtagacagatggtaaggaacgcgccgagcacgagcatggtctgccagccggttcgggtggatagcaggatggccatggcaaggattgggccgagttcgccccacgttccgtacgagatgatggcgtcgccgatgggggtgccttcgaggttgcgttccttgagaatcggcatgagtgtgccgagagcggtggtggtaagtgctattaccgtggcgatgccgttgatgccttgctttgcgaagaatggaagcagggtcacgacgagtccggcgagccccaaggtgatgatccatgtgacaaggccgactttgccttgatgtccggcgagtcgtttcgggtcgatttcatagccggcgagcaggaataggaacgccatgccgagctcgctcaagagtttcacggcgtcgttcacctcgattacgcccagtccgtacggaccgagtgcggctccggtgacgagcagcagcacagtttgtggaatgaaccttcctggaatcagctgcgccacaatcgggctgacggccgccaccgccatgatgatagtcaatgaaacgagctcttgcgtcatgtttctagcctagtgagtctgcatgacggtgttcaaggacgtgatgccccatgatgagccaaagggcactctggggcaaggttaagtttttgtaaattttatgg

SEQ ID NO: 78 - DNA, 109783 bp, Bifidobacterium pseudocatenulatum
  misc_feature (104823)..(104832): n is a, c, g, or t
ttggacctctggtatccccagaggtccaaggttcaaatccatgccccgctactgatgaaagctaggaattgcaacaattcctagcttttttgttttccgtcaaatctcaccaaaaccaatttccggacaaaatctggacaaaatccgacaaaaaccgggtatatcagccgagttcatcaatcgcatgtgccgaaagtatggagaaaatgcgccggatccgccaatcgcatgtgccgaaagcgaagattgccgctcaaggctgaaaatccaacgttctccaaggttgcacgcgctacgttgacctcgccaaccacatatcaccggatataaggagaacaaggcaatgcattatatgaatcaagcgaacgcgcacaacgcgacgcaggacaccacaatgcaagacagcgcaacgcacgatacggcaacaaaggcaacgcaggacaccgcgccgctgaaaggcatcaccgtgattgactggacgcaggtgcagtccggcccgtcgtgcacgcagatgctcgcatggatgggcgccgacgtcatcaaggtggagaaggtgcagggcggagatccgacacgtaatgaaatgaacgacgtggatggctcgtactccctgtacttccttcagctcaatgccaacaagaaatccatcacgctgaacatgagagatccggaaggcaagaaaatcctcgccgaactcctgaagaaagccgacgtgttcgtagagaatatcggcccgggagacgtggaaaagcttggtttcggatggaatgacgtacatgcgatcaatccgcgtctgatcatggcgtcgctgaagggcttcaacaagggcagccggttcgagcatgtcaaggcgttcgagccggtcgcgcagtccgcgggcggtgccgcttccaccaccggctggtatgacggcgagcgcaatgtgcccacgcagtccggcgccgcattgggcgattccaacagcggaatgcatctgctgatcgccattctttcggcgctgttgcagcgcgagcataccggtgagggttgctatgtgtaccagtcgatgcagaatgcggtgctgaacttgtgccgtgtcaagctgcgcgaccagttgattctcgaccgtttgggcaagctttcctactatgactgctacccgaattatgagtggggcaagcaaggcaaagccattccgcgcgcagcgaatgcggagggtggtttggtgcttggctggtgctaccgcgcgaaaggctgggagcatgacccgaacgcttacgtatatatagtggttcaacagtccaagaagggcttcgagaatttctgccatgcgatgggattcgaggattggctgaccgacccgcgtttcaataccgccaatgcgcgtgacgagcataaaaccgaggtgtaccagcgtgttgaggcgtacaccatgcagttcgacaagtacacgctgaccaaggaattgggtgcgaagggcgtgccggtcggcccggtgttggattggtatgagttggagaacgatcctgatttgaatggggatggcacgattgtgaccattgaccagcaggatgcgcgcggcgatttcaagacgatcggcatgccgtttacgatgagtaatttcgtgccggattaccagcgtgcgccgaagctgggcgagcataaccgtgagattctgcatgcgttgggatatgacgacgatcagatcgcttcgctgcgtgattccggtgtgatcggcggtaacgatggtgtgcaggctgatttgaagtaacgcacgttagcgcgcactggcgcacgaataagggcggatcacaagattcgcccttattcgttatgcgtcacatccattgcagtccacgccccgcacttccgcacacaatcccatgtcttacgtcttacggtttaccgtcacaaaaagcgcatgcagtaacggaacgttggaatttcaacgttccgttactatatgcgcttcgtgagctacagtgaggatactgaatcagcccacgcagaaggggacgagccagatccacagcagacaggtggccgcgaatgccaccgtggcgacggccgttgtcgaggcgccttcttttacataaatgttgtaacggctggaaataatgatgcctgagaacgccggcggcaacgcgaccgccatcaccagcatcgaaatcttgttcatgtcaccgcccatgccacacaacagcgccacgccaaggaacactgcaggcgtcagaatcaggcggaagaacgtgttccagatggtttcccaaccgagcgagaatttcaccgtggaaagcgcgaggcccgcggaaagcacggccacaccggaattcgctttggcgatcagatcgaaggtcggcgccacctggcttggcacatgaacgcccaccaacactaggaaaatggccaataacgacgcccagcagatcggttgcttcagtgcgtcgagcaacgcctgcagattgctgttgcggttttttcccgtattcgacgtgccatgcaccataagttcggcggttttgtcggttgcggcatctcgcgccgggtcaagcgtgatatcgctttttgcattggcctttgcattgaccgcgttttcggcctgcacgctaagcttcgctcggtctttagcctggccgaggttgatcagatacatgccgatcggaatggtcaccacgttgaccacgatggaaataatggctatgacgagattcgtgctgacggtgttgccgtaaatcggatcaagcacagcgaatccaaggaaaccaatcgtcggagatcctgcgatcagagcacagacggccgcctcctgaatgctgcggtggaacagcaaccggcacagataatagctcaccataaacatgacgatgacgccgatgaaactgatggcggtcaatgttgcgtctttcgcaagcattgcacgggtcgatttgatgatggacacaaataacgccgcaggaagcgcgatattcaacacaagtttattaagtccctgccgctgatcgtcatcaaaataactgaattttccacaaatataccctaatgccataatgacaataattggcacgatgtcgtcaacaagtatgtttatcactgtcgttctttctttatattttttctatctgcaatcttctgcaatattgtttgattgctgatattgcggatattgcagatacgttgatcggatcattggttttcaggcagaaaaagtgggcgcacgcattccaccgttcgcacgcccacatgtcataccgacagccgatgcgctacatgcgagcgccggtcgcgtagtcgtacatggtgacttcggaatcaacgagggctccgaccaccggcttcggattcaacgctccgatattgccggattccttgcccgcatactgcgcgatctgcacatgcacgaagcttggcttgcctgattcgaccgcctcgccgaccatgcgttcgacttcttccggagtggtggcatagtaacctttacccccgaacgcttcgaggaccttctcgtaatgcgagttgtaggtaagcgtcagcggcgacggatcaccgtccgctccaaggttttcgaagtcgccgcggtagataccgccgttgttgagcaccacgaaggtgatgggcagctggtagcggcaggccacctccacttccataccatcgaagccgaatgcggaatcgccgccgatgtacagcactttcttgccagtggaaagcgccgcgccaatcgcatagccggtgccgcagcccatcacaccccacgtgccgcagtccaaacgatggcgcggttcgagcatgtcgatgatgttgcggcaatcatcgagcgaattggctccctcattggtgagaatgagatcttcatggtgtttgttgtacacctttttgatggctcccaaggcgttgaaatggctcatgggcagctgatcggattgttcgcgggtttcaaatttcgccacgtttttcgcgctggcttccttcagcatgttcagccaggtttcgtcagctttgaacgggtattcttccagagatccgttgagcagcgtcatggcggaacgaatatcccccacgattggtacgtcgatactgcgcgtgttttcgatttcttccggattgatgtcgatttggatgaatttcacatgttcgttccacgttttgccctggccgaacgacagcatccagttgagtcgcgcgccgaccagcaataccacgtcggcgttgcgtagcgcggtggaacggcagcttgccgtgctgtgtgggtcggtatcgggcactacgcctttggccatggacattggctggaatggaatatccgttttcttgacgaattcgcggatttcctcttcggcgcgggcgattgcggcgcctttgccgatcaccatgagcggacgttcggcctgccgcagcaatgcgagcgccgcgtcgatggatttgcgtgccggcaccatggcgggggccgggtcggttgccgtccacatcaggcggtcggcttcgctttggctcagggtctgtgccacggtgtcatcggggaaatcgatgtacaccgcgcctgggcgtcctgaagaggcgatatgcatggcacgggccaccgcgagcggaatatcttcgatgcggtcgatgcgcagcgaagccttgcagaactgcttggcgtagttcatctggtcgaggccttcgtattcgccttcctcaaggtcgaccacatggcgggttgaggagccgccgatcatgatgaccggatagccgttcaccgtggcttccagcagtgccggtagaccgttgaggaatcccggagcggataccgtcaacgtgacagccggccgaccggtgatgaatccgtcggccgcggccgcgttcacagcgtcctcctcatggcgcatgcccacgaatcgcatacccatgccctgcgcgatgcgcgcgaaatcggtgacgggaatgccgaccacgccatacatgtttcgtatgccgttggccatcagcacccgcgccagataatgcggcgcatcggtgaccttccgatcatcggctccctgccgttcggcatccgcacgcatgctcgcgaccatcgtttcatctgcatgttcttctgtcatcgcaacctccattcgtatcgacgacgccatgattgtagatacgtgaaaatgggagttcgtcagcagaaaaatatgttcgtctgcggcttaatttcaacgttttcagcatgatatagccgtattctcacgcacatgcggaatatattgcagctgaaatatcgcaactctcatcgagaagcatcacctccgcgagacgacatcatcgccgcatatcatcgtcgccgtaccgcatacagcatgaacgccccgcagcacatcacggcagccgccaaacccaacaccagccccatcggacttcctgtctgcggcatttcctgctcgggggtataaaggttgtcgacattgaacgtcagcaggctatcctcacgttccaccacatcgttcagcaccatcattttctgcgcggtgacggcctcatccaatcccacggactggtatccgaccttgatattgacctcgccggcacccgttgcatgccaatacacggtggttccctccagttcggcccagccgactgccgtgggctcgtcgtcctcgtcgaacacggccggaccttcgatcgtcgccgtgaatacgccctcgatcggctgtccactcgaatccagcaactgcacgaacaggcttccggaccgcaatccctgccgatcatcacgcgtcaccctcgaagaaaccggcagcttgttcgcggcctcctcccaaagctcgttgaccttgctttccagcccgtccatcaccgagaagaggtattgctcatgcctgacccacaccttttggtcgtcatagttgcggtgcaccagcacgccgatcgccgcatacgtgagcaccggttccccgtcatgttgatattcggacagcagccatgcgaggcgccgcgccgcttccgtattttccacggtggtggtttcggtgaccttatagtcggtcatgctttcgatttgccggcaataatagaatttgcccgatctcgattccgcgttcaccccgatcacatacggttttccatcgagaaaatagttgtaatgcttgccgttcgcgcgcatcagctgttcggcggccagcgcggccgggcaggtcattcccacaattatgatgcaggccgccaataccgcggccagaatcgcaagcgtatgtcgtttcatcgcattcatcgcatcgtcctttcgatatgcacatcgttgttgtcgtaattcaacaggcttgcatacttgcgattgccacatagccttttttaagggttgtggtcggaggacgttctttttgccgtttttgtggacaacttcgcttgtcagcaaacgtaacttatccacaaaaaacgttttaccaatcgtaggtaaacaagttatccacaaagggtggaaatcgctggtcggaagatagttcacccaaatccaccttttctcctctataatcggcggtatggcagaagaagataagagcgcggaaccgcgcaccaccgcaaccaagcaaccagccgtcaagaagacgaccgccaaaagcgcggccgccaaaacggcatcggcaacttctcagacgcctagcaagcgcaccgccgcagccaaaaagtccacggcatccaccgctcgcaagcgcaccaccaaagcgaaggccgccgcaccgcaaacggtcggcgaagccccagcccccgtcatcgaacgcaccagccccgaacagttcggccgcgtgaacgtgctcgacatcaccccgaacgttgagaacggcctgttcccggcacgcgtggagctcggcgaagcattcaacgtcaccgcccaagtgttcatcgaaggccgcaccaaggcaggagcgaccgtgtccgtgcgtaacgcacgcggccgcgaggttgaacgtttcgccatgacctgcaccaatccgggcctcgaccgctgggaagccatggtcaagatcggcgaacacagcgatctgaagccgtgggatgccgattatgccgccgtcaagcgtcagctgggcgaatggcagatcgtgatcgaaggctgggaagacacctaccagtcttggctgcacgacgccgccatcaaggttaaagtgaatgacgacgtggagaatgcgctggaatccggcgcacagctgctcgcacgttgggctgacgcgaaggattccaagctttccgcagccgacaagaaggtgctgcgcgacgccgccaagaccatggaaaacaagtcgctgagcgccgaagagcgtctcgccgcagtccagagcagcgacatcgagcagctgcacgaaaccaacccgttgcgcgacggcctgtccgagtcgaatccgcagcgtttccgtgtggaacgcccgaagtccagcttcgcctcctggtatcagttcttcccacgttccgaaggagcctactacggtgaagacggcaagatcgttcccggcaacctcaagacgtcgatcgccggcttggaacgcgccgcagccgaaggcttcaacattgtgtatttgccgccgatcttcccgattggcgtgaccaaccgcaagggacgcaacaattccctggtagccggcccgaacgatccgggctccccgttcggcatcggctccgaactgggtggccacgacaccgttgacccgcagcttggcaccatggacgatttcaaagcattctgcgagcgcgcccacgagctgggcttggaaatcgcgcttgatttcgctttgcagtgctcgcctgaccatccgtgggtcaaggcgcatccgaactggttccgcaccaagccggacggcaccatcgcattcgcagagaatccaccgaagaagtatcaggacatttacccgatcgacttcaatgccgacatggaaggcatcgaaaaggaagtcgaacgcattatggatctgtgggtcaaggcgggtgtgacgatcttccgcgttgacaatcctcacaccaagccggtgcgtttctggcaggatgtgattgccgccgttacgaagaagcatccggaagtgctgttccttgccgaggcgttcacccgcccgggcatgatgcgcgcgctgagctatgtgggcttcacgcagtcgcactgctacttcccgtggcgtaacaccaaggaagagctcgaagagtacctcgaagagaccaacggcaatggcggcttctaccagcacaacacgttctggcccaccactccggatattctcaccgcctacgtgcgcgacaacggcattgccggccatgcggtgcgtgcggtgctcgccgctatgggcagcccgagctggggtatttacaacggctacgagctgatcgaaaacaagcagcgtccgggcttcgaagagcagatcgacaacgagaagtacgaagtcaaggtgcgcgattgggacagcaccgaaaagtacggcatcgccgaactgctgacctcgctcaacaagatccgtgacactcacccggcttgccgcagctaccacaacctgcacattctgccgagcgacgacgcgggcgtgatcgcattcctgcgtcagactccggccgaactgaccggtaccggcaaggcagatacgatgatcgtgatcgtgaacctcgacggacacaacgcgcaccagtccattgtgcacatcgagcttggcgacttcggtttcgccaccgacaagccgctcaaggtgcatgatgagctgaccggccgcgacttcgaatggggttacgacaactacgtttcgctcgccccttgggccgacgtggcacacgtgctcaccgtagtcgaagactgattgagtctcaatcgatctgattaatctcggtcagctcgactagaaattcgtttcgattcataccacaataccggttccacttcggtggaaagcggtattgtggttactgataatgcaaactgcccaatctcaaggagaaatgacatggcagaaaccttcaacgtcgtggtggaaattccgcgcggctccaagaacaagtacgaagtggaccacgagaccggccgcgtgttcctggaccgcaccctgttcacttccatgggttacccggatgactatggctacatcgacggcactctgggcgaggatggcgatccgctcgacgcgctcgtcatgatcccgaactccgtgttcccgggctgcgtggtggaatgccgcgccgttggcctgtaccacatggtcgacgaggctggcggagatgacaaggtgctgtgcgtgccggctgacgtacgtttcgacgacatcaaggatgtcgaagacgtttccgagtatcacaaggctgaaatcaagcacttcttcgagcagtacaaggctctggagccgggcaaggaagtgctgccgggcgattactggaccggtgccgccaaggccgaggaagaaatcgtggccgcccgcaagcgcctcgaagaatccgagaagtgatttccacgcctttctagatagctttaggtagcaatccaaggaaagcccgttgacgtacgcactcgcacacgtcaacgggcttttgcataccttccaacgtccagattccgccagtcactggaagaatcctcccgcaaaccagcccctcagcgggcaaaaacctccactcactggaacaatcaccccactaacacggcttccagcggacaaattcccccagtcactggaagaaaatgcccgcaaatcaacttctcagcgggcagattcctccaccgattggaggaaaacggacaaaaccataccctccaagtgtccagattcctccagcgagtggaagaaacagcccgcagacgggatacactcatactgcacgcgcatattcgtcggggccgctatagtggaacacgtaattcacggcatgcgaacagtattcgcagaattcaaagcccgctggctggcgcggcagttctatgtcggtacccctaggcgtaggcggacgtgagactccgtcgaggcccatcccgtgggaaaccggcgggatgaacctatataccagctatgttgattcaaacattacttattgccgtttccgtatcgatggacacattcgccgtttccatcggcaaaggtctcaccgtcaaaaaactacgcggcctcgacgcgttcaaaaccgccctctggttcggcggatttcaggcgcttttcccactgctcggctatttcgccgcctccacgttcagcaaatacgtgaccgccgtcgaccattggatcattttcggcctgctcgccctcatcggcggcaacatggtgcgtgaagcattcgaagaggatgaagagaacgccaaggaaaccgctgatttcgattggaagcacatgcttccgctcgccgtggcctgcagcatcgacgcattcgccgtcggcgtcagtttcgcattcatgtcgttgaacatttggatttcagtgatcatcatcggcatcaccaccggcctgttctccgcagccggtctgtatatcggtcgcgcgttcggctcgcgctggcagaagcccgcacagatcgcaggtggcgtcgtgcttattctgatcggcgtgaaagtattgctggaacatctcggattcctcgcataataatcgcaaatcagatatacaaataaatatacaaacttacagtaaaagcccgtaatcgcacatgattatgggcttttacattaccgcttaccgcaaatacttgcgattattttcctgcgctttcgcgttttctcgcgattgcaggaatcacactattagaacatgacggtcgcgtacgatgcgataccgaccacaattccggaaatcataaccggcagcagcgcaatgccgatccacggattcttggattgcggatcgggatcggcatcacgattccaccaatacgaacacgcgtcaagcgcgataatcagcagcaacgccacaatcaccgcaacagcccacgccgtcgtcgagccataatcggtggaagccgcgttttcgccggaacgaatcggcagcagcgtcgataggaagcaccagcccgcgctgccaatcatggcaacgccttccacaacattgtgcgacagcgaacgaatcagatgcgtacggttctcacgcgccatctgacgcccgaacgaaaccacaatcagcaggatcagcagaccgccgacgccggcgatccagccttcctgcatccaaaacgtgtcttcgtcacccaaaccggcagggaaaatcgcacgtccgagcatcatcgtcgtggcacacaccacggaaagcaagcccgcaatcacggaaatcgcatgccccgcaacaccatcgcggaacgggttgaacacggcaagcagcgcaatcatcgccacggaagccacaaccgtgaacgacacgattgcgggctcttccgcattcccataggaaatgccgggaatcagagcaagcacaaccagcaccacatatgcggcgatttggacggcaaacaccttgccgaacgaggctttctgagccgacttgacggcaactttttcagaggcggtcatttcgtccccttttcatgattttccataatgtggtcattacgtatgcgataccattaaatgtagccgcaagtgtccacatagttcagataaagttaatgaaacgccgacaacacacaacaagagtacaatcgcggcaacgatacaaaaccagtacaagagacaaagggagctaacgtgacggatctgacgcttatgacgttcgctagcgacccagctaccgtgcttccttctctggcgctgctttcccaccgcgtacgcgtgctaccaatggacgcggcaagtctggtgaaaatgccggaaaacaccattctttttctggatgcgcgagatgatctggccacggcgaaaacattgtgccgcctgattcatgcatccggactgtccacgccgatcgtgctcgtcctcaccgagggtggcttcaccgtggtcaattcgcagtggggcatcgccgacgtggtggtggcgtccgcttccccggccgaagttgaggggcgtcttcgcttggtatccgagcgcggcaactcgccggtcaatgcggtttccggttccggagaatcgggcgtgcagaacgaagacggcatgatccactccggcgacctggtggtggacaccaacggctatacggcaagtctgcatgggcatccgatcgacttggcatacaaggagttcgagcttctcaagtacctcgtgcagcatccgggacgcgtgttcacccgcgcgcagctgctgcaggaagtgtggggctacgactattacggcggcacccgcaccgtcgacgtgcatatccgtcgtcttcgcgccaagctgggcggcgaatacgagcatgtgatcggtaccgtgcgcaatgtcggctatcgttttgatcctccggaagaagaggaaggcgaggcggcagccaaggacgccgcagcccacaacgcttcgagcgaaaactgattgtcgcactattcgcattgctggcattgcctgcgatttgcgatgcttgcgattgccacgatacttgcgatctgactgtcggctatctcactttcgtacgcgcgattgcatattcatgcgacggtagactggtgccatgccccgggaatcgaaacaagcgcgactgtcacgcatgcatcaggaatacgccgtattgtgcgaggagattccgcatccgaaatgcgcgctgaatttttcaaacccgtttgagctgctggtggcgaccgtgctaagcgcgcaaaccaccgacaaacgcgtgaatatggtcacaccggaattattcggcgaatatccgggaccggccgcacttgcgagcgccaatcccgaacacgtggaaagcatcattcattccatcggatttcatcatacgaaggcaaagaacatcatcggactttcttacgcattgtgcgaacggttcgacggcgaggtgccgcaaaccatggatgctttgacaagtctgcccggggtcgggcgcaaaaccgcgaacgtggtgcttggcaatgcttttggcgtgccgggattccctgtcgacacgcatgtgatccgtgtgaccgggcggctgcgctggcgttcggactgggcgagcggctcccccgaccccaaagccatcgaacgagagatcaccgcctgcttcccgcccgaagagtggacggacctgtctcacaggctgatattgcatggtcgtgccatatgccatgcgcgcaagcccgactgcctcaactgcccccttaacgacacctgtccgagcgcattcgcagcgtaacgcgcatgcccgctgtagcctgtgccaactagactcagcaccatggaagacaccatggaagaagaaaacgggcgggaagccaagctgaaagccgaaatcacgcgatggctgatctttttcggcgtcgccatcatgctcagcgtcatgacctggctgggctggtcgctgacgaaccgcaaaaatccgattacctccttcaccacgctcgtttccgactcctccgtggccatcggcattcagggcagcgcgccggaatcgctcgacatccgcaccgaacagggcaccgcgctggagcaggcgctgctcgaaaacgtgtacgaaaccctggtgtcacgcagcgaaaccaacaaactgcagccgtcaatcgcgaaatcatggcagatttccgacgacggactgacctacacgttcacactcaacagcaacatgaccttcgccaacggccataaactcgactcgtccgacgtggtctggtcgctgcaaaacgtcatcaacaacaattacgtgggatccgaccaacttggtagtctcaaggaaatcaccaatcccgacgaaaaaacggtggtcatcaccctcaatcagccgaatccgtgccttctgcgcgcgttgagcgggcgtgccggcattgtttacgatgaggaaagcacggcgaattacggcaagaaagccgtgggatcgggaccgttcaccgtggaagcctcgtcgaaaacacagatcgtgctgcagcgcaacgactcgtattggggcaccaaagccgccgcatcgcaaataacgctgtattactacgcttccgaagattcgctggtcagcgcaatggaagccaagaaaatcagcatggcattgccgttgagcgcgtctgccgccgatgagctcaaccagcaaagcggcatcaactccgacagcggcatcagcttcgacaaagtgatgctcgccttcaataacggcaccgaaagcccgttctccgacgagcagatccgcaaaatgacgagatacgccatcgacgcgcagaccatcgccaaagacgctccggacgcctattcgccgctcggaggcccgataagcccgctggaagacgggtatgaggatctgagcgaactgttcccctacaatcttgagcagggccagcagatgcgcagctatttcggcgcatactatatcgccgatatcgatctgctggtgcccaaggaatatgagcagatcggcaacaccgtgaaatcggcgatcgaacagctcaatatcggcgtccatctggaagtgctcgattccgcggcgcaagtcacggaacgcatgaacgcgggcacctacaatatcgcgctcaccaccatgagcggcgaaaacgatgcgagcgtattcaccgacggccaaagcgtgttccattatgagaacggcgatgtgcagcaggcatatgcggacgcgatggcggccaccaatgatgacgattatcaggcacgcatgcgcacgtatgcacgcgccgtcagcgaaaacgcggcaagcgactggctgtacacgcgcaagaatttcatggcggtaagcgaccaattgcagggatatccgaaaaatctgaccgaccgtctgctgccgttgagcagagtgaagttgcagtgattttcccgcgattgtcaatcaatcgccgaacactgcggacaatccgtgtgttgcgctgattttcttgcgatttcggcattcggctgcagttccgtaagttgtcacattcgctttctagactagcgtttatgactgaaagccaagatactaccatcaacgcgaacctcacgccgctgcccgacaaggtcggcgtggacggtctcgaagacaagtggcgcgaagtctgggacgaaagcgaagtctacaagttccagggcacccgcgaccgcaaggccgtgtactccatcgacaccccgccgcccaccgtttccggccacctgcacgtgggccacgtgttctcgtacacgcataccgatgtgatcgcgcgattcaagcgcatgaacggctacgacgtgttctacccgatgggctgggatgacaacggcctgccaaccgaacgccgtgtgcagaactattacggcgtgcgtgtggacacctccctcaagtacgatcctgatttcgtgccgccgttcgaaggcaccgatggcaagaagatcgacgccaaggatcaggttccgatctcccgtaagaacttcatcgaactgtgcgagaagctcaccgcccaggatgagaagcagttcgaggcgctgtggcgttccctcggcctgtccatcgactggacgcagacctaccacaccatcggcgagcacccgcagcgcgtggcccagaaggcgttcctgcgcaatctggcccgcggcgaagcgtatcagaaagacgctccgggcctgtgggatgtgaccttccagaccgcagtggcccaggccgagctggaatcccgcgaatatccgggcttctaccacaaggtggcgttccgcttcgaagacggcactccgatctacatcgaaaccacccgtccggaactgctggcagcctgcggcgcactgatcgcgcacccggatgacgagcgttacaagccgtatttcggccagtacgtctactccccgctgttccacgtgaaggtgccgattctggcgcacaaggccgcggaaatggacaagggcgcaggtatcgccatgtgctgtacgttcggtgacgtgaccgacgttgagtggtggcgtgatctgaacctgccgctgcgttccatcatccagcgcaacggacgcatcgtgatggacaccccggactggatcgaagacgaggaaggcaagcgcgtcttccaggaaaccgccggcaagacgacattctccgcacgcaagatcatcgtcgacgcactgcgcgaatccggcgatcttgacggcgaaccgactccgaccaagcgtatgacgaacttctacgagaagggtgacaagccgctcgaaatcgtcacttcccgccagtggtacctcaagaacggcggcaccgatcagaagctgaacgccgaactgatcgaacgcggtcgcgaactgaacttccatcctgatttcatgcgcgtgcgttacgaaaactgggtgaacggcctgaatggcgattggctgatctcccgtcagcgcttcttcggcgtgccgttcccgctgtggtatccggtgaaggaagatggcaccgccgattacgatcatccgatcgtgccgagcgaggaccgcttgccgatcgatccgaccgacgatgtgccggaaggctacagcgaggaccagcgcgacgtgcccggtggcttcaccgccgaacctgacatcatggatacgtgggcgacctcgtcgctcaccccgcagatcgtgacccgctgggaagagccaggcgaagagaaccaggcgattttcaacgccaccttcccgatggatctgcgtccgcagggtcaggacatcatccgcacctggctgttctccaccgtggatcgcgcgcatctcgagaacaagtgtctgccgtgggccaatgccaccctgtctggatggattcttgatccggatcacaagaagatgtcgaagtccaagggcaacgtagttgtgccagacaagccgatcaagcagttcggcgccgacgcggtgcgttattgggccgctgcggcacgtttgggcctggatgccacctacgacgaaggccagatgaagatcggccgccgtttggccatcaagctgctcaacgccaccaagttcgcactggccatcggccgtgaggatgagaaccaccatgtgggcgctccggcaaccgcaagctggaaccctgccgacgtgaccgagccgctggaccgcgcagccatggccaagatggccctcgtagtgcgcgaagccaccgaaagcctcaacaactacgagcattccaaggctttggaagtcatcgaaaactacttctggcagttctgcgacgattacatcgagctggtcaagaaccgtgcatacggcaccgcagactccaccggccatgtgccgagcgagaaggccgtgaagtccgctcgcaccacgctgggactgggcttggatgccttcgcacgcctgctggcaccgtacctgccgtacgccaccgaagaagtgtggagctggatgcatgagggcgaaggctccgtgcaccacgccgcatggccgaaggctgaaacgtacgatgcggccgcagcagccgtctccccggagctgctcacccatgccggtgaagctctggccgcgctgcgtggcatcaagtcgaaggccaaggtttcgatgaagaccccgatcctttccgtgcagctgggcgtttccgatgaagcgcgcgaatccatcgaaagcgcattgggcgatatcgccgaagccggtcgcgtggtcggacgcatctccttcatgggagcggccgccgcactgaaggccgtcaaggaaaccgccgaagcagccaaggaagccgtcaaggaggccaaggctgatgccgaagcagccatcgacgtgattgtggccgacagcgaacttggagagccgccggctaaaaagcctaagaactaatggcaactgtaggtgaaaccggcagccttcgtggcaaagccgttcacttcacctacagacagtccacaggactgtctgcttaacggctcagccggctaaaaagcctaagaggggatcttccacgattggaaggccccctctttgtgtatctggatcctatgtttatacatttttataaaacgggaactgcaagcagatattgagattgcgcggccttagcaggctgcgattgcacaggcatatccggatacagcttctgcaaagcctgctgcaatatttcggcagcggccgcaatttcaacggtctcgtcaatcaaatcgctattatcaggcacaatcaacgtgcgatttccggaaccagcaatgccgtatgctgcaatcggcaacgcacttgtcatcaacatttcggaagatgcggtttttcctgttgttccagtattttcagatgcggaatctaccgaatcgccatcgctggatttctttgattccactcccccgactttcgcaacgttcttcgacgtggtatcggcagccgcgccaaatgacgatcgcaggccgcccgcgtagctcatcacatcatccatgctgatggcgttcttgtcgtccaccaagctggccgcagtaccgtcggaagcgttctgctgattggccgcatccgcctgcgcgcgttcctctttgcgttgggccttgatacgcgcccgctcggcacggcccgcaagcgacgtctccgaagccgaggcaagtcccatagaccccttcaacgtaacttccgaaccatcgacagtatcgtcggaactggtcgaatcatcacctgcatcaagctgatccgcaaaacgaagcacgatctggtggaacgcactggcctgacccgtgtgctcgctcgcatccgccaacgcctgcatcgcatcgtcaaccctgcttgaagccgacttcaacttctcattgccgtcaatgctgttgcgcacatccgcaatcgcctgagattccaagttttgcgccgaacctgcggaagcccccaattccttaagccgagcggtgtatgcgtcggtgaaatccatggaatacggaatcatcgccgaagaaagctgcgactggccggcactgtaatccttggcgccacgctgctgctcctcgcccgcacgcttgttgagttccgccaccaaaccggatgtgccacgctgttcgatggtgcgaatcacctcgttcaccgcgtcggcggcacccgtatgtcggtatgcggcgctcacatcgttgaccgcgttggccagatcgaccacggactgcgccaccgcagtatcgccgttcagttcggccgcggtgccgagaatggcggtaagttgcgtggtatcgccaatcgatccggaaagatgcgtcgtatacgagccgacgtacgcgtcgatatacccgttgaacgcctgctcatgttcctgctcacgctgggcgatggtcgtttcggcaagctccttttcatgatcgcgcagttgttcgagctgcgcgatgagctcatggttgcgttgcgatccgacattcgtcaaaccatccaccaatgtggatgcgcgatcggtcaaactggtgagattgccatagcagccagttctttcggaatcgcaggcaacagcggcgacagacagcgaactcatggtgaagtttttcgcagtcacatacgtatgaatcgtaagatcctcacccggcttgcctaccgcagcgaccaatgtcgacgaattgccggcagacacaagcacgccttcgtctgaggtcgcgtcattgccgacgcggttgggaatggtgaacgcgacgatcggcgtcagatcagccgtttcctccggtcgttccgatttcagatcgatgcggatgccgaccacgcccgatgcaccggaaatcttggatgcgctgacggtcggaccgtccaaagtaaaggtcgccgttatatcccacggcagttccacacgctcttgcggcacgcgctgcgaagacgtcgcgccctcatctgcattcatgtccgtatcagttgcagaagcggcgtcactcgtcaaatacaagcggcccggctcatcaacggactcatatgcgctcatcacatcgtgcgaggccaccgccgagacgtactcgccgttccgacgcaccacatcaaccacattcgaaaccccgaccgcgcacacgggagccgccgaaaccagcgttaccgcaatggacgcagccagcatgtgccgcagatggacactcgccacacgcatatcacgctcaccacgcgtgctatcggcatgatgggcacaagatgcacgaaacgcaacagaacgacgcatgccgagcctctcaatcgcaatcaaaacaacgttccaaagcaatcaatgtagcgcgcggcatgccccggcaagaaacgatttcgcggaaaacagacaggtcaggcgaatacgtcaagcgcacccggatcgacgccgttctcggcgatgcgcttatgcctgcgcttggcttcggtcaccacgaattcgcgatacatttcggcgatgtcgggatccaacccggcatcgacagcaatgcggtgcaaccgttcgatctggtaatcctcacgcttgtaatcggccggcgcgaaaccctcgcgggctttcagcacacccacttgggacgtgtatttgaagcgttccgccagtagggaaacgatggccgtgtcgacattgtcgatcgactggcgcaatgcagcgattttcgccacggcatcggcgacctcgggattgctttgcgcggtgcccgcatcgatgacggtttcggtttcatgctcttcttctggccgaagccagtcatgttcgctatcgctcatgcgtacaagactaccgcgcgcatgtcacttggagaagtaccgttgcagcacaatcgtggtttccgtgctcaccggcaccgtttggtggatgacgttcagcagatcctcaagcttgcttggcgaggctgcgcgcacggtcagcatgtagctgggtgacccagccacggaatcgcacgacatgatgccttcgatatcctgcaatttggcgggaatctcggcttccttggaataatcgatcggcgtgaccgcaatgtaggcacgtacggcgaggccacgcttttcatcgtcgataacggccttgtagccgagaatcacattacgacgttccagtttctgcacgcgcgattgcaccgcggaaatcgacagtcccgtagcatccgaaagctgagacagcgtagcgcggccgtctttctccagcatgctgagaatggtctcgtcgatatcgtcgaattggcccacgctcgcatgcgtggcgtcgggttcgttgccattgcctgtcatagatgcccctttccaacaagcattctgcatcagtccggtaggaccgactcccctatgcagctcacgtttccgtccattaccatacccaccccaacacacaatccgtcaactgcattttcgtaacatttccaacgaatttcgattttcaatcatttttctcctatttttttcatataccccctatatagcaatactattttcgtctttttactttcgatttcgtattttttcgtgcgtcgatttttacataccgtatgtccacaacgtgatcatccacattgccgaatcgtgcggaactttcgaaaaacaatcgaaacgcattcgaaagtagttgaaaactgcaaaacggaaaaacagccgaacagaaagacagccgaacagaaagacagccgaacgaaacaaaagggccgcatggcgattgtcatacgacccttggatgcgtaaccgcagattgcgattacctgcgattagctgttgccgttattcgcggtattgccgctctgctggatcagcgacgccatgaaatcacggttggtcgcggtcttcttcagacgcggcacaagcgtctggtaagcctgctcaggctccagaccgccaagcagacgacgcagacggtagatgatcggcagctcctgcggatcggtgatgagttcctcgcgacgggtgccggaagcgttcacgtcgatggccgggaacaggcgcttgtcggccagttcgcggctcaggcgcagctccatgttgccggtgcccttgaactcctcgaaaatcacctcgtccatcttggagccggtttccaccagtgcggaggagatgatggtcagagagccgccgttttcgatgttacgagcggcaccgaagaacttcttcggtgggtacaacgcctgggcatccacaccaccggaaagaatacggccggaagccggagcggcgatgttgtaggcacgggccagacgggtcatggaatcaagcagcaccaccacgtcctggccaagctccacgagacgcttcgcgcgttcgatggcgagttcggcgacggtggtgtggtcggaggccggacggtcgaaggtggaggaaatgacctcgccctgcaccgtacgttccatatcggtgacctcttccggacgttcgtccacgagcacgaccatcaggtggacttccggattgttggtggcgatcgcgttggcgatgttctgcagggtgatggtcttgccggccttcggcggagacacgatcaggccacgctggcccttgccgatcggcgccacgatgtcgatgaggcggccggtgagcttgttcggcgcggtttcctgcttcagacgctcctgcggatacagcggagtgagcttgttgaactgcggacggttctgtgcggcctccacggtcatgccgttgatggagtcgatggactgcagcggcacgaacttctgacgctggttgcggcggtcgccctcacgcggggtacggatggaaccgtgcacggcatcacccttgcgcagcccatacttcttgacctggcccatggaaacgtacacgtcgttcggacccggcaaatagccggaggtacgcacgaaagcgtaggaatcgagcacgtcgacgatgcccgcgacaggcacgagatcctctttcggctcctcgtgacgctgttcgcgttcaacattgcgatccgtgcgctcgttgcgctcgacgcgatcgttacgctcgttacgatcattgttacggtcgccggtacggccacgacgctcgtcacgctcgtcataatcgcggtcacggccacgcaggcgacggccacgacgatccacgcggtcacccctatcgctgacgcgaccgcgaccacgacgcgcgaaatcaccgtcttcagcctcgtcacgacgttcgtcatcatcactgccctgcgaaggcaacgtggcgagaatgtcatcaagatcgcgcacaacgtcctcatccttcggcccttccaccgcacgacggcgacggcgcggctcaacgtcggacgcatcatccttacgatggcgacgacgatcatcctgcttcggcgaagcatcgtccaatcccagttcggccagcagatcggtggcagcgtccgcatcacggcggcgacggcgcttcggagcctcatcgatgctgtccagggcgttcaccgcggccatgacatcggccgcctcctcgctcgtcggagcctcagcctgcttgcgacggtcagcacgctcggtgcgctcggcacgttccgtctgttcggagcgctccgcacgctcagcgctatcagcacgtccggcaagggtcttcctaacggttttggccgtctgcttttcggactgctcagcctcgttggctttgctttcggcagcctcgttggacttgccggattcctcagccgtgttcgccgcgacctcagcgtctgcggtttgggcttcagcatgagccaccggagcggccggtgcagcggacttcggagctcgcacggtcacaccggcaggcgcttcaccgccggaacgagcggcctgaagcgtcgcgataagttccggcttacgcatggtggaggtgccacgaaggcccatctgcttggcgagctccttgagctcaggcagtttcatgtcttcaagattcgggctggttgccactggtttttgcctttcccctagctttcgcaagcacacgcctgcaacagctgtaaaaagagatacggaaatttccgccactgaaagtccgccgcgaaatatcacggttttcgaacttccctaaccatacaacgtcatccagaccaacgcaacgtaggcgtgccaacgtattcatgccaatcaagcattcaagtcaatgacaaatcgcaaatcacaatgcgaaagacccgccatgcgatcacatgacgggtctttcgctttaccacatgctttacagcaacaggtgcaggtcttgccggaacctacttttcctcgtgatagctcttatcggtattgacggaccatacgttcttcttggacgtcttgccgttcttgatattgccgacggcctcgattgcggtggccatggaatgatccatgttgttgtaacgatgctggccgttgcggccgacacaatacagattgccgaaggaatcgaggtattccacgagctcaggcatgcgatcgtaggtgtcgaaatatgccggatacgccttcttcacgcgctcacgatgggagtcgatcacgtcttgcggaccgttgatgatctgcatgcgcgtaagctcctggatggcgaacttcttcgcttcctcgtcagacatgttccagaaggaatcgccttcttcgcagaagtattcaagaccgatccacacggtgttgtcaacgtccttgaccaggtacgggctccagttgttgaagatctgcaaacggccgaccttgtagcccggatcctgcacgtaaatccagcaatcaggcacgatcggcgggttgccgagggtgggaatgtcggtggtgttcgacaggcgcaggtgcttgacgagcagaccaacggtcacgaagtcgcggtacggcaggccgttggcgatttcggtcatgtccttcggcgcgggctggctggaagcgtccacggcgttgatgagatccttgacgggcatggaggagatgaagtcgtccgcggccatttcggtgcggttgccttcggaatcctcatataccacggatgcgatcttgccgtcggcctggcgaatctccaccacgttcgcgtcggtgatgaccttcacgcccgcggcctcgcagttggcctcgacggtttcccacagctggcccggaccatacttcggataccagaattcctcaatcagcgaggtttcaacctcagcattgctgcgcttcttcggcaggagcttctggaacgcgttcttcagcacgcccataatgctcaggcccttgacgcgctgcgcaccccaatcggcggaaatctgggacggatggcgaccccacagcttctcggtgtacccctcgaagaacatggaatacagcttgcggccgaaacgattgatgtagaagttctccagattgtcttccggcagcttgtgcaccatggacttcagatagctgaagccggcaacaagcgtaagcttcggacccatggccttcaacgtgttggcgctcagggaaatcgggtagtcaaagaagtggcggttccagtaaatacgagacacgcgatgacgcttaagcatcaccttgtcttcgacttccggatccggtccgcccggttccatatcgtgctcgcgaccgagcttcttgtcatcatagcttggcgcgccctgcagcggcaggacccccttccaccaatccatgatgcgttcgtccttcgagaagaaacgatggccgccaatatccatacggttgccatcatgcttgacggtgcgggagatgccgccgaattcgcgggtcgcttccaacacagtcacgtcgtagttctcggagccaccgtccttgacgagctcccaagcggcagtcaggcctgcagggccaccgccgataatcaccacggattgcttttgcgtcactttgaggtctccttatgaaaacaaaaatccctgatagtctacccgagggtagggaaacgaacaccgcaacttgtgcgaatacttacaaaatcaagccaagtcagccggatatacggctatcgcatcatgcaaaacgcaatcatcaaaccggccgatgcacgacccgactgcgcggccaaagcgcgcaaccacattacgcaatccaactacgcgaccagcaaccgcacaactggcaaccgcgtgaccggcaactgcgcagctagatggaatcaggaatgtcaatatcggttttctgcacttcctcaacattgacatccttgaacgtgacgatacgcacgttcttgacgaaacgactggaacgatagacgtcccacacccaagcatcagtcaggcgcacgtcgaaatacacgtcctggcctgcggaacgcacattgaaatcgactttattcgccaaataaaagcgacgttccgtttcaacaacatacgtaaacagcttgattacgtcgcgatactccttatacagagccagttccgcgtcggtttcgtaattatcgagatcctcggcgctcatcacttaccttccgtatcgcgcttgcggccacgaccaagcgtgcgccaccaagcttccttcgacgtcttacgctcgcccgccgtgtacggccagctgttttcggcatcggcatcgccagtaacggacttgcgatcatcatgctcgctttgtcgcgcaggttccgcgccctccgcgtccttccgcacagcctcggccacgtcaccagcaccatcggaagaagctttctgcacggattgcgcagctgccgcggcatcgttgacatccgtaccttccgcatcatgcttcgaagcattcttctcattcagtcggatggcaatggaatgctcgcgcgcgctcaacgcttccttgacgcccggattatcttcgatcacatgcatgccgaacgcgtcaagcgaacggatcgggtcgaactcgtcaaccagcgtgtccataacgatcagatcctggtaacggttctgcgaagcgttccacaaggcgtcgcgcgaacgaccggacggcacgaatcccaacgactggtacacggacacggaacgcgtgttctgctcgggcacggcaacccaaatgcgatgcatgccaaggcctgccggttccggcgcaagtccgtacgtcatcacgcgcggcatgatgtcacgcgaatagccacggccgcggtaatccttgccaagcaccacctgaatgcgcgcggaacgagcccaaccgtcaatatcgatcaggaaaatcatgccaatcacattgtcggaattcgcggcatcgatctcgccatcgccatcatggtcggcttcggtgatgatggaccatgcgatcgtgcgacgcgactccggatcccccacaccggattcggtcggcgtttcgccttgggaccatgccacggaacgacgcacccacgcatgcaccgcgccacgctcggcaacccgatccttgccggtgattccggaagcgccgatgtacgccccaatggcgtccatacgttcaagatcttcgatcacggacggacgcagatgcaccatctcgcccttgatagacggaatgacgatgagatccggcaattcacgcgactgctggtccaactgctcctgtgtcgcagcctcaacttgttctggcattattcctgtcccctacatcattgcaggcacgaccgtcgccgcacccataccgagggtattgtacccgactgtatgtcagctgtgaatccgcgcggcggcaatcgctgtacatattcctctaccagcataacctgatgttgaaggacatgtcggcaatcgtaagaaaatgcgcttcgcgattatgcattctctttctttgaaatcccttttccggaataacgaaaagaaaacgcacgtcccaagctttttggaacgtgcgttttcctgcgattcaacaatcggctgtaatcgtcagcaatcgttgtaaacgttacttgatcttgctcatcacgatcttggtgacggcctttgcgtcagcctgaccgcgagtggcacgcatgacggcaccaatgatggcgcccatcggcttcatattgccgctcttgagcttttcaacgatgtcaggattggctgcgagagcctcatccacggccttttcgagagcgccgtcatcagacacgacctggaagccatgcttcttgacgacctcatccggagtgccttcgccagcaagcacaccggcgacggtctgcttggccagcttgtcgttgagcttgccatcggcgatcagcttctcaacctcagcaacatcggccggagcgatcggtagctcttcgaggctcacgcccttgttgttggcttcacggctcagctcgcccagccaccacttcttggcacctgcggcggtggcaccagccttaacggtctcctcaagcagatccagagcgtcggcgttgagcacgtcacgcatctccaaatcgttgaagccccactcgcccttcaggcggttgcggcgctcgcgcggcatttccggcatctgagccttcatctcttcgatgtgctccttggtgatgtgcagcatcaccagatccggatccgggaagtagcggtaatcgtcggcatcggacttcacgcggccgcctgcggtggtctgcgaagcctcatcccagtggcgggtttcctgcagaatctcgccgccttcgctcagaatggccgcctgacggcgaatctcatactgaatggtcttttcaataccgcggaacgagttcacgttcttggtttcggaacgggtgccgaacggatcggacgggctgttgcgcagcgacacgttcacgtcggcacgcatgttgccctgctccatacgagcgtgggaaatattaagcgcacgcacgatgtcgcggatggcgcgcatgtaggcaccggcgatttccggagcacgatcgcctgcgccaacgatcggcttggtcacgatttcgatcagaggaacgcctgcacggttgtagtcgaccagggagtggtcagcgccttcgatacggccgtcagcgccaccgacgtgggtgttcttgcctgcgtcgtcttcgatgtgggcgcgttcgatcggcacacggaacacggtgccgtcttcaagttccacatcaagatagccgttgccgttggtcggcttgtcatactgcgagatctggtaatcgcgcggcatgtccgggtagaagtagttcttacgcgcgaactggctccactcggcaatttcgcaatgcagggcaagacccagcttgatggcgtaatcgacggcggtcttgttgaccaccggcagagaacccggcagaccaaggctcaccggggtgagctggctgttcggatcgccaccgaacgagacttcggccgggcagaacagcttcgtggtggtgctcagctcaacatgggtttccagaccgatgaccggatcgaacttcttgacggcatcggcgtacttcatcaacttttcagccattttgttttctttcctccgatgcttcctacttgttcaagccgtcgagccacggggtcttcagggactgccagatcggaccgttccagtcttcctcgagagccgcctcaagtgccgcggcaggcttgtacatggcctcgtcacgctgctgcggagcgaggaactggaagccaaccggcaagccgtcgtcgctcagaccagcaggaatgctcatggccggaacgcctgcaaggttggccggaatggtggtgatatcgatggcgtacatggccatcggatcctcggtcttctcaccgaacttgaatgcggtgaccgggctggtcgggccaacaagcacgtcgaccttctcgaaagccttcttgaaatcgtcgatgatcagggtgcgcaccttctgtgcggaaccgtaccatgcatcgtaataaccggcggacagggcatacgtgccaaggatgatacgacgcttgacctcgtcgccgaaaccggcttcacgagtgtaggccatcatgttggcggcggtctgcggaacgcctgccggcggcatgacgcgcagaccgtaacgcatgccatcgtaacgagccaggttggagctgacctcggacggcatgatgatgtagtacgcgccaagggagtacggcaggtgcggcagagacacttcagtgacttcagcgcccatctcctcaagcttcttgacaccttcgttgaagcgtgccataacgcccggctggaagccttcgccgccgagctccttgatcagaccgaccttgaggcccttcagatcacgcttcatgccttcgcgggcggccgccaccatcgggcgagggccttccggaatggacgtggaatcgcgcttgtcgtggcctccgatcacttcctgcagcagggccgcgtcgagcacagtacgggagcatgggccgatctggtcgagcgaggaagccatggcgattgcgccgaaacgagagacaccgccgtaggtcggcttgacaccgacggtaccggtcagcgagcccggctgacggatggagccaccggtgtcggtacccagggcgagcggggcttcgaatgcggccacggcagctgcggaaccaccgccggaaccgcccggaacacgttcggtatcccacggattgtgtgtggtctggtaggcggaatgctcggtggacgaaccctgagcgaactcatcgaggttggtcttgcccagcagcggcatgcccgctgccttgagcttctcgatgacggtggcatcgtacgggggcacccagccttcgaggatcttggaggccgcggtggtttcgatgcccttggtgacgatcatgtctttgatggcgatcggcacaccggcgagttccggcagtgctgccttttcctcatcggacttggcatcgaaggcgtcggcctgttcgagggcctgatcgccggacaccttcaggaaagccttgatgctcggctcggcggcctcgatgacttcgagatgcgcttcaaccagttcacggctggagacttccttggccttgatcttagccgccatctcggcggcggaaagcttgacgagttcgctcatgtcactcctcccccagaatgcgcggtgcaacgaacatgccggcctcggaaaccggggctcctgcggtcgcctcttcctgagtcagcggggtttccggcacatccgggcgcaggtaggcttccagcggaatcgggttcgcggttggttccacatcgtcggtagcgacttcctggaccttgttgatggattctgcgatgacgttcagatcgccctgcagacgggtgatctcctcgtcagtaagtgcaattcgggccaaatcgcccagatgcacaatttcttctttggtgaaagtaggcatgtccctaacattaacgcgtctgtgtgacgagcgcccgcccatttcgcctcgcccggcagccccaccacgctcccgccctaccaccccaccaaagtcccaattcccccggcagccccacactgcatgccgcccggcagccccacacgctaaccgcaacagcctgccgcaccaacaccccagctctgtcagagtcccaaatcccccacccactggaacaaaaggacgccaaacgctgtttcaccgggcaaatccctccagacactggaggattcttcccgccaacaagccatccacagtcccaaaacctccactcactggaacaatccgggcccaaaccagcctctcatcgtcccgattcgtccacccgctggaagaatcttcccgctgaacgctctgctggagtccggattcctccagaagatggaaggatcctcccgcggaaggccccactagaggccaaaatcccccagtcattggaacaaaacggacactaaaagcaatacaaccgtctaaaaacctccagccactggatgaattctcccactagcgcttcgtcagagcccctattcctccacccaatggaagaattctcccgcaagccagccatccacagtcccaatacctccacccaatggaggaatctggactctgaacggcatcccaatacttaaaaatatccaaccaatagaagaaaacaacaaaaattcacacaaaacaagcggatacaagcacttatctgcaaaacaaccacccagttatccacaaaacccgtaagttatccacagacacgcccgaaacagcatcctctatccacatttgccgatcgcacttccatagcagagccacaacaaggtagcgtcaaatcatgaaagcatatcctcaaatcgatgcgctgctcgatcaaacagaaaatgcgcaacgatgcgcacacagcagtgaccctctcatccagaagggactatatcgcagataccgcgcgggagatttggcgcgcccatacccagggctattcgcccgtgccgaatattggaatcagctgaacgagcccgaacaatcgttgcacgcggcccgaaccctcagcaggctccaccccaactgggttttcgcaggaataacagccgccgcagcccacggattcgaccacccgcgattcctgcaccggcaaggactgaccataacattgcccaatcacggatcataccggccgcacgacaaactcaatatcatctacagcccatatcccagagaaaatgcggtactcgcaaacggaatccatgtcactaatccccctcgtaccttattggactgtggacggacgttagagttcatctattccctgccgattttcgatgatgcagcagcagacggaatcgaagaaaagcagatcttgcaggaatgcgcacgcacgacactcgattgctcgcgcatcttcaaattgttgagatataccgacgcaggaagtgaaaatggcggtgaatcttttgctcgggcagtcatgattgaaaacggttttgcggttcctcaattgcaagtctccttcgccgactcgcttacgggaaaacaatttagggtcgattttttatggcgcacaaccgatggacgtattattgtcggagaacttgacggcacagcaaaatacgttgatccgaaaatgactgatcgtaggagcatccaggagaccgttcaggccgagcgagaacgcgagcaagcgctttttcgcgcaggagttacggaaattgtcagattaacttttgacgatgcagtccagcaaaaaccgctgattgcgaaactgcggcgtgctggggttccttgcgtttcatagggtaatcatctgcgggaagattcctccagtaagtggaggaatcggaacgttgagaagctcgccaccggcgaagattcctccagagggtggagaaatctagactctagcagggcactcagcggaaagattgctccagtgggtggaggttttgggtctctggtgaggctttcagagggaagattcctccagcgactggaagaatcaggactctgacaggcttgttagcgggaagattgctccagtaagtggaggaatcttcccgcagaacaccgtactaaagtcccaacctctccagtcactgaaggactcaccccgccagacgccccacaggagacccaaaacctccacccactggaacaatcatcccgctgacagaactccaatcgtcccgattcttccagtcactggaggattttggacgataggagatggaggttagagctggggagcggcgtgctgggagatccatgcgtgcatggaaacggcggccgcggctccggcattgatggaacgcaccgaaccgaactgggagatgtaaaccacatcgtcggccaactcaagcgctttttcggacaatcccgggccttccgcgccaaacagcatgaggcaacgcttcggaaaacggtacgtttccatcggcaccgcacccggaataatatcaagcgcaataacccgcgccgccttcaactcggcaatacgctgatcaatcgcagccaattgcgccatgcaggtaggctcgaatccattcccaacgccgcttgcatccgaagcatccgtcgaaatgccagatggagcgcatccagcaacacggccttcagccaacaaagcatcgcttacgccggcatcgtttccagcttccacattttttcccgcgctttcatgcatacgaaatgcgatggcggccgcctgcgattgcgccgccgcgatttctccggcaatgcgcagcttccagcattcgacaagttcggttatggaagggtggttttcgacgtgctggtacagctccgtcatcagcgaccccttgcgattccacttgtgcggtccgacgatatgcacacgtttcgcttggaacgcgttcgccgtgcgcaccatggatccgatgttgaaatcgtgcgtccagttttccacggcgacttcgaaatcatggcgaccgcgagcgtcaagatcggctttgatggccgcgaccgcccagtagcgatactggtcaagcacgttgcgacgatcgccctcgtcaagcaaagacgagtcgaatcggcgatcataatttacagattgcggatcatccggacgaggctcacccggatgtgtttcggcccacggccctacacccacctcgcgaaagaccggctcgccagacgctttcgctgcaatatcaatgggatgaggctgatgcacgcgattcctccttacgaacctcgtatcgccaatggctggtcaacaggatacctagtgaagctccgattccttgaacacttcaacgaacggcagctcggattcagacccatccaccggattgatgaccttgatcgtcggctcggtcatgtcaacgccgccgatcagcgaagcgatggcaagcacctcggcgccctcgttcttcaccacggagaaatcaaggctcaactcattgccattgcgcaaggtaaccaaagaggacgtctgtacatacgacttttcagacagccaggaatccagcaacaccacgcgcttacccgcgatcgacggtcccttaatggacggatacacgaaatccatcacaaaaccgttgagattctcaccgcgcgaagcggccgcctgaatcatggcggacaccagcggaaccgcggccgcggtcaacgcgcccacggcgtcgaaatcatccacggaatagccggattcttccaacgcgtccagcagaatatgcccgacaatcgaagcgccacgatgatcgaacaatacagaggaaagctccgagaacggcttgtcggccatctctgcctgcaacagcgacttcagctggtcacgcggctcaagcatggcgaaatcgatgtcgctatgctcaggagcatcggcaggcacagcaaccggattggtcttacggaaagtcttctcttcgatcatactcccagcctaccgtttctactcgtcaaaccttacttatgccgacacgtatttagtcagatatcactgttcactggtttcgggagcggtgagttcgcggatgtcggctttttcgggcgcgatcatgttcacggcttcgatgattctgctctggtcgacgcgctgcagctttcgcgcggttaccagcacacgcgattccagcgacgaggcgaacgcattgtaggcaccgaccgttttggtgatggcggacccgagtttggtggcacgatcgcccaacaccgcgaaccgttcatacaattcgcgggacaggtcgaacagcattttcgcgtcatcggtcaggctttgctgctgccacgcgtatgccacggatttcagcaccgcccatagggtgatcggcgaggtcaaagccaccttgcgcgcaaacgcgtcgtccatcagcgtcgggtcagtttccaaagccgcctgcagcagggattcgttgggaatgaaggcgatcacaaaatcgggggcatcgtcgaacgcgttccaataggccttgtcgcccaaggtcttcacatgttcacgcactgccttggcatgcgcatgcagcagctccgactttcgcgtcagctcctcgggcgtggcggtatcgggaatctcgcacgccttctggtagtcggcgtacggagccttggcatcgatcggaatggttttgccacccggcatgtggatgaccatatccggacgctgcgtatgcccatccacgtcggtgacgaccacctgggtgtcgaaatccacatgctccagcagcccggcggattccacgatgttcctcagctgcgcctcgccccacgcgccacgcaccttgttgttgcgcaacgccgacgacaaagcgttggtttcgcggtcaagacgggcctgctgctcgccaagccccttgagctgctcgccaagcgcacccatctcccgtttgcgcccttcttcgatctgcgaaaccttctgctgcaaggcgtcaagattcttctgcacgggcgcgagcgcggacaataccttgctctgctcctgcagttttcgctcgttttcggcctgcttgcgttccgcttcggccgcggcacgctcacgctcccgctccacacgttcctgttcggcccgctgggcctgcgcgagctgcgatttgagataggtcaactgttgggccaacccttccgcctgcgtgcggtattgggtcaccgccgtggacaattcgctgatttcctgccgatcagcttcgatctgcgctttcgcctcgttaagatcagcggttttcgcatcacgggccatttcctgccctttggaacggcccgcaaaaaagccggccgcggctccaagcgcagccacaaccaccagaagaatcaccacaaacacaggattgtcgaacatatgttctatataacagcatgaccaagacatcttggaagatcaaagttcgcaagacatccatgcccagctgcattatgcttggagccgaaagcatgctcacgaacatgcggcaacgcgagcacgctgaatattcgagaggcattcaagaggcaatccgggggttcggaaacacatgggattcgatttgtttatgacggtagcggcgattgttgcggcggccgtggccacttgggccatcctcaggctattcctaggcgaaaacgatgacatagccccctcccaccaacgcatcaccgatgacaagcccgccaagaatcacaccgaaaatccagacgaggcagccggcgcaacacaccgaagcgacatcgccaagcgtctcgccatcgcaaccatactgaccgctcccacattcaccgtaaccatgctgacattcggcggcatcacacttccccactggctgaccaatccatggctgcacgccatcatcgccacgccggtcatgttctactgcgccgcgccgatgcacaatcgcggtatcgccgccctgaaaagccacacgcccaacgcggattcgctgctgtcgctcgccatgaccattgtgtacgtctacagtctgctggcgtgcgtggtgtcgtggattttccccgcggggtcacgcaatcagtatttcgctttcgcaagcatggtcgccgtgctatcgcttgcgatttcgctgatcgcgcaacgccccatggcaaagaaagcatcggaaggcgatattccgaccgcacaatcgcaagaaaagcaagaaatacaatctcaagaaacgcaagaaacacagcaaagcatggatacgcttatccaggccagcatcacatatgagattcgcacgcgggtaacgcagattaccgcgaccgtgacgatggtcatcgcggtgtggacgttcgctttgtggctgattttcgggcttcagccgaagcttgcgatcgccgtgttgatcggtgcgacggttttgacggtcgcaggcttggttttgcaggcatacgaccgccaaccgtcacggtaaaacggttttcgcaaaagaaaatcgcgcaatcgcacgaaaaatgggcggacccgcatgtgcgcagtccgcccaccgtcaacggttagaccgttttcgtgactcggccaatcaacagtcagtcaggccaaaccgatcagccgaatgactccgaccgtcacttagcctctgccgaaaaatcgtcgtcaatctgccccggcgcccacgaggagagctccaaatggtcgccgccggtctgatccacaagcacggtgtcgccgtcgtgcacttcgccggccagcagcatgcgcgccaactggtcgccgacttcggtttgtaccaaacgacgcagcgggcgagcgccatacgccgggtcgtaaccggtgttggcgagccaatcgcgcgccgaatcggtaacatccagcttgatgcggcgatccgccaagcgggccgaaacctgcgccacctgaatgtccacgatgccgccgagctcttcgcgcgtaagcgggtggaacataaccagttcatccaagcggttgatgaattccggcttgaactgcatatgcacggcgtccatcacggccttcttcttggcttcgtcatccagttcggtgttcaccaggaactgcgagccaaggttggaggtcatgatcagaatcgtgttcttgaagtccacggtcctgccctgcccgtcggtcaaacggccgtcgtcgagcacctgcaacagcacgtcgaatacttcaggattggccttttcaacctcatcgaacagcaccaccgaatatgggcggcgacgcacggcctcagtcagctggccaccctcctcatagccgatgtagcccggcgcagcaccgatcagacgagacacggaggccttctccatgtactcgctcatgtcaatgcgcaccatggccttttcatcgtcgaacaggaagtcggcgagcgccttggcgagctcggtcttgcccacgccggtcgggccgaggaacaggaacgagccggttgggcggttcgggtcggaaatgcccgcacgcgaacgacgtaccgcatcggaaaccgcttgaatggcttccttctggccgatcacacgtttgccgagatagtcttccatggtcagcagcttctcgttttcgccttgcatgaggcgtccgacgggaatgcccgtccagtcggacacgatttcggccacggagtcggcgtcaacgcggtccggcaccatcggaatatcgccacccaagccaccgtcagcaccgcctgccgcaccgttcttggccgcagcctcgttttgttcggcttgcgcgatctccttctggatggccggaatttcgccatagttgatggcggaggatttcgccaaatcgccttcgcgttcataccgttcggcttgggtgcgtagttcgtcgagcttcttgcgcaggtcgccgatgcggttgtgtccgttcttttcggcgtcccagcgtgctttcagaccgttgagtttctcgcttttgtcggcgatttccttgttgaggtcgtcgagacgttccttggcgctttcatcaagctcgttttccgctttctgcgcgtcggcatcgtctttcggattgccaagcaggtacgatttttccatcttgagacggtcgacctgacgctgcagttcgtcgatttcctcaggcgaggagtcgagttccatgcgcaggtgcgatgcggcctcgtcaaccagatcgatggctttgtccggcagctgacggccggaaatataccggttcgacagcgtcgccgcggccacgagcgcatcgtctccgatggtcaccttgtggtgggcctcgtatttcggtgcgatgccacgcaggatggcgatggtgtcttccacgctcggctctcctacgaacacctgctggaaacggcgttccaatgccggatccttttcgatgttctcacggtattcgtcgagtgtggtggcaccgatcagacgcagttcgcctcgcgcgagcatgggtttgagcatgttgcccgcgtccatggatccttcggccgcgcccgcgccgacgatggtatggatctcatcgatgaacgtgatgatctgcccgtctgcgttcttgatttcctgcagcacgctcttcaggcgttcctcgaactcgccacggtatttcgaacctgccaccatggagcccagatcaagcgagatgagcttcttgttttgcagggtggtcggcacatcgccggcgacgatacgctgcgcgaggccttccaccacggcggttttgcccacgccaggctcgccgatcagcaccggattgttcttggtgcggcggctcaggatctggatgactcggcggatttcctgatcgcggccgatcacggggtcgagcttgccttctttcgcggctgccgtcaggtcggtcgaatacttttcgagggctttgtaggagccttcggcgtcgggactggtcactttcgcgcctcctcggatcgttggcacggctttgcgtagcgcgtcggcggtcacgccgtattgttccatgatttgcgcgctctgattcggctttgccgccgcgatggcgatgagcagatgttcggtggatacgtattcgtcgcccatctgctgcatttccttgccggcttgcgcaagtactgcggatagttgcctgctgacttgcggttgcgcggtggtcgatccgctggcgcttggcagcgcgtcctgcgcttggtgcacggcggcgctgatgttttgcgcgttgccgcccgcggcttcgatcagaccgcggatcacgccgttttcctggcgcagcagcgcgtcaagcaggtgcagggtttcgacttgcgcgttgcctgctgccgacgcgttctgtacggcgtcggaaatggcttcctgcgccattgtggtgaacttctgttccatatcatcctccatggttcgcgccgatcgtccgtttttcgcacggccgcgccgacgcatatgtcgttgtctgacatgctcaaccgacttcaccaccattctattcccaaaagttgagcctgcaacactcaacttttgttcactaaacgggaaatcgcgaacaacgcagcacaaaggccgtcgcccacgaaaggtgacggccttcatatcttcaatatgtcaatcagcaatcggcaatcagccgcgcaccaccacgttgcgcaggctgccgacgccttcgacgtgcacgatcgcctcatcgcccggatcaagatggccggaagcgttcggcgtgcccgtcagaatcacgtcgcccggcagcagcgtcgtgaagctggaaatcgccgcgatctgctccggaatgccgtgaatcagattcgccgtggtgccggaagccagctcgacatcctcaccgttcagcgtgaaggagatcttcgcgtccttccaatccaaatcgtcgcgggtcacgatccacgggccgagcgggcaggaggtgtcgaagcctttcgcacgcgtccacatcgggtcaagtccctgcaggtcacgcaatgtcacatcgttcacgcaagtgaagccgagcacgtaatccatggcctgttcgaccgtcacgttcttggcgatgcgccccatcaccacggccacttccggctcgaaattcatatcgttcgagtacgacgggatcacgatcggatcgtccgggccgatcaccgacgtgctcggcttggagaagatcaccatgtcttccggagcgtgcttgatgtcggaatggcctgcttcatgcatgaactgcgcgtgcgcctcgtaattcttggccagcccgtataccttcgacgggatcaccggagagagcagacgaacgccatcgccatccaccggaaaacgctcgccggtcggcttcacaccggcaccggccagaggatgcccctcaagcgccacgagatagtccttgccgtcgctttcgtcggtctgcacgaaagcgtattgcggtacatcattatgcgaaaaacgtgcgattctcatgtctgccagtctacccgcaacaatcgtcgaatcgtccatatcatcgacatgcaacgcccgacaatcaaaaacatcgaaaaaaaacgggccatcacatcatgcgaaggcccgtcacaggaagaaaacgtcagataaaagcgcgctcgccgaaaatcgcggtaccgacgcgcacgatggtggatccttccgcaaccgcaagttccatgtcgccggtcatgcccatcgacagttcgcggcaggattgcgtgcccggctcgccggattcgagaatatggtcgcgggttttgcgcaggtgctcgaatcccttgcggatggcggtttcgtcgtcgacatgcgcgccgatggtcatcagcccctgcaattcaagtccgtccaatgtaccgattttttgcgcgatgcggatggcatgcgagggatcgcagccggatttcgacgcctcacccgattcgttgacttccagcagcacgcccacggtgatgccgcgcgccacggccctgcgcgagattttctccgccaagtcaagggaatcaaccgattcgatggtgttgacgaccggcagcactttgccgatcttattgctttgcagctggccgatcagatggaacggaatatgctcacccgcaatagtggaagcgccggcatcgtcggcaacgcccaacgcgaatccgcgctccccgcaacgtgccatcaatccttcggccttcgccatcacttcctgcggacgattctcgccgatcatacgcacgccagcgtcgatcgcagccatgatctcacccacgtcgcgcgttttcgtggcggcaagcaggcgtacggaacctgcgtcacgcccggcatgctgctccgccgatgcgatgcggtccagcacacggtgcacgccatcggcgatctgcacggcacgcacaccgtcgatcacctcattggcaagattcttatggtccatatatgcagtcatgttcagcctcttgcgttcaaatcccaactacctctaccagagtaagaagaagcccgtacgacggtctgaagtgaagcgataaagcgaccgatatccgtacgggctaataaaacagacggcagtagaagggggaacttcaaagactccgtccgacagcaactatatgcaagatttactaaacacgcgccgaaaaaaactttttacttcaaaaaaaatttctcagcgaactcaaattcagccttgcgattcgtctaatttgcgttccaaagcatcaacgcgttccttcaacgcaagcacctgacacgtcagcgatcgaatctgccccaactgcacagtcaccaatcgttccctggtgtcggaagacaaggcgcccgtcgtggaattgcttcttgcggccgccataatatccagatccactttccaacgtgcgatattacgttccacacgcttgcgcccgatgatcgcagggctcaacccagccgacgtgaaaatcgtgctcggccgctcgccatccaaatatcggcgcatgcaactgatctgaaaatcacgcgaatacgtgatccgattttccgtaaccgactcaaccgccggcaacgcacgaagatactcgacctccgtgttactaaactgccttttcgtcatatcgaccccattcatccgacaaaacggaataccattctcgtgctcgtagattaccatcacaaacgaacgcacccgaacggcatatactaccactttaacgtaaggctatgggggctcacgccacctgaatcgccctacgctaaacctagctaaaccccaacgggtacagttgcgtactgccacagtcaacccaccaaaggagcagccatgaccggccgattcgcaccaaccccatcaggacgcatgcacatcggcaacgtttacgccatgctcggagcatggctttccgcccgcaaatcgggtgattccatacggctgcgcatcgaagacatcgacgagccacgagtggttcccggcgccgccgaaaccatgatgcgcgatctcgaatggcttggtctcggttgggatgacgaaccggtattccagtcgtcgcgacacgccctataccaggaagcgcttgagcttctcagcaagctgagctttgacgaaatcagcgatattatcagtactggttccaacgattccaagccctgcagcactacagcaggcaacgaagcagccacctctgaggcaacaccgctcatctacccctgcttctgctcgcgcgccgacatccgcgccgcctctgcaccacaggaaggcgatcgtttcaccgtgtacccaggaacatgccgacgcctcatcgccagcgaaccgcagcgtgcgaaacaacgcctcgccaacaacgaccgccactcgatgcgcatcgccaccgccgacaccaccatcaccttccacgacgaagtattcggcacccagcaataccacctcgcccacgacatcggcgacatcatcgtgcgccgctcggacggcatctactcctaccagctggccgtcaccgtggacgacctcgacatgggcatcaccgacattgtgcgcggccgtgatctgcttcgctccaacgctttgcaaatctacattcgcaaagcccttatcaacgcgggattcaagccttccgaaccgacacagcccttccatcctgccgacggttccaataaacctgacgatgtgaccatctcatacgcgcatctgcccctcatcgacaacgcagccggccaacgccttgccaaacgcgagcgctcgctcgatctcggcatactcacggcacacggcgccaccgcgcaacagatcatcggctattgcgcatggctgctcggattgcagggagacctgaaacacaccaaaccgcagcctatgagcgccgacgaagcgcttggcgtattcagttgggatgccgttcgcgccaacacgtcagaccgcacgctcgatcaaggcgagttcaacgcatatttcggactgtaggccctattctgcagttttattctgcagttttattctgcagctctattccgcaatcgcgttcagccaatccataattccgaatcaagcggatattcgttgatcgcacagccatccaaaaatatggactgctcctgcataagcggtgccgcttggccagcccccgcgcacgtcatctcattgtcgatatgccccaaccggtgcccgacctcatgattgatcaccatcgtgcgatatcgcgccaagtcgccgcctcccgacatccacacgtccgtgccggaattccaacgatcatcgttgataatcacattgttgcccacacggcagctgtattgctccgaacataccgacgagaacgtcggcaaggtcgacgcttgagcgagcacgatattgaaatcgcaattgccgttcgtagaaggttcgaaaatcgcgcctgcgcgcccatccatgttcgctgttcagaatacgaaacacggcattcgaaaaatcttcgactgatccgacttcaccattggtgaccacacagtaatgatattgcaccatgccatatccgctgttttgcgccgtttgctgcgctttcgcaagtatttcgcttttctgatcgtccatcagcgcggccgactgctcgcgaagcgctttggtgacggcgtcttcctgcggttccgccgtttcctccgctgaggcctttgcgtctttcgtttccgacgattcctaggttttcttctctgattgttgcgatttcttttcggatttcgcggattgatccgttttttctgaatgtgttccggaattgccgatctgcgccgttttcgcatgtccgttcagtaccgcgttgaccagcacggcatgcacgctgcacgacgtacatgacacgatgacgcataatgcaagaatccaagccacgacgcttctgcggatgcggaacgcttccgtccgttcccggcggctcatggtggcggccgctttcggatcgagcgcacgcagaatggtacgaattcgcttcaatccggcctccttataaccctgccgtcacgcaggtggcagcatatctcctccgcggcaacactaccagccaacagtaggcatgcaaaaagcccgcttcccccgtaccggaaattttccgaggaaaacaggctttatgcaacagttctcatatatcaaacgcaacttatgcgacggtcaggcaaacaagtcacgaatgattgaatgcgatcaggcgaacaacttgaacacggacgcacccacgatagcgcccagaatcggggcgacaaccggaatccaagcctcgccccagcgggaggagcccttggacgggatcggcaggatggcgtgcagcagtcgcggcatgagatcacgggccgggttcaggccaggaccggtcgggccgcccatggaagtcacgagaccccacacaatgaagccgaccacgatggaagcggcagcgtggtccgcttcgccccacggcatggacaggcagcacagggcgccgaacacgagcacgagggtgccgaagaactcgttgacgaagtagttgatgcggtcgttgtgggcgtcggtggtgcagaaggtgccgaggatggcgttggcgttttcggtgtccttatagtgcgggtagtaggtgatgtacaccacgagctgacctgcggcggcaccaagcagctgggcgatgatgtacggcagcacgaggctccagtcgaacaggccgttcacagcctgggcgatggtcatggccgggttgatgtgcgcgccggagacggcaccgaacatgagcaccgggatcatcacgccgaagccgtagcccatggcgatgttcagccagcccgcatggtggcccttggtgttcttcagttcaacgttcgcgacagcgccgttgccgaagatcatcagaatggcggtaccgaagaattcggccgcaagtttgacaaaagtcgagtattccactgctgtttcctctattgcttcttctcaataagaatcagattgatgtcgattccgctctcggcggacaacagcgtccaacactactccccgcactggaagtcagtatgccactaggtatgacgtcatagcgctggtttcatatgttggatattgcactcgtagtttgattcggcaaaccgcggtttcgccagttccaccattgtcgtcagtactgccgaccgctgggcagcgtcacatcgaattcggaattatacgattgcgtttcgttgatatggtatgtggatccgccttggctgacccaagtaccgccgaattgttcggctttgtcgtcacctgcggatttcatgctgccggtccacgtaccgccagtctgcatagtcatctgcatttcggtaatggtcagacctgccgccttggcagagaatccccatgtgccaatgagattgcctttcgcagccttcttcggtgtggtcagcgtggccacaaccatggtgctggctttatctatagatgatgaatccactccgaagaactctgcaataccgatgtcttcgccatccctgtagaaatgaagattagagatgtcgtactgcgcgttggagcctgtcgacctgcccttgccaagagtgcccacgatcttgtcttctgcaatcagagtaatacgtcattattctcagacaaagaagcaaatcgatgatcggaccgcacgtgggcctttgagcatatcggaaccaaagttattgtctataccctcggaagttattaccagggtggacgcgccgggggattgaacctggaacgcgtgtcttcatggagtgatgaggcgtcggccggcatgcgggagccatagtgagtccgtcgcgggaagccagtagggccggtacgtaagtccatccacgggaattcatcgcaaagccttttccttagcatcccatttcctccacccgctggacgttttgcccgctggaaggcttgcttccgggtagattcccccagtcactggaggaatcaggactccgaagcgtgcgccagcgggtagatttccccaccggctggaagaatcaggacgctgagacgccagtcgatgggtggattcctccaccgactggacgttttgcccgctggaaggcttgctttccgggtagattcccccagtcactggaggaatcaagatgctgaagcgtgcgccagcgggaagcttcccccaccgactggatgtttcgcccgctgaaaggcccacttccgggaagatccctccaccgattggatgttttcggactctgggatgcttacaaacgggaagattcctccactgactggaggaatcaggacgctggagaaccttgccgatagtacggatgcggagtacgaggaggataggcccgagaaacagtttctacgcaaactgcagtggatgtgggagtagacatgcgagcatcagaaaacaaaaaaaccttggaaccggagttccaaggttttgtctgtgccccctcagggattcgaaccctggacacgctgattaagagtcagctgctctaaccaactgagctaaaggggcgttggtcttgcgaggttttgttctcgctgagcacaagaagtaaatatactcagaatcaagaagaacgcaactctcggcgtgtcgcgattgtagaaccgctatttttcaacgatttcagcatattgcataaattacagaaaaatgcgatccagccgtcatgttccctatctaaacagcacagccaaggcaggaaatcacaatttcttcacaactgtcgttccgcgtaatccaatcgccccaaacacttccgccaattcacttcgctaatttatttgcacggccatgcaatcattctccccgaatccattgtccgaacaccatgcacgcgcatcagccaccgaaccgaactcctccccggaaagaagcacgtaataatcggcctcatgcccataccgcgtgtagtagctgtagtccgcggcccacgccaacaccgccttcggccatgaagcgcgcgatgtaagatactgcgcgtaaatatcgcggtattgctgggttttgccgtcgacttccataccgtatttacgactgaacagctgcgttgtcggaatgtcgtacagtccggaaaccgccgaccggtcatgagacagctgccagctcaacgccagctgcgcatagcgttccgcatcggagtcggcaatgttcgcgccaccccttgcgtctcccacactcgcaaccgcattaccgttcggcgtcgcacccttctgcaccaccatgctggtcgacttggtttcgatctggtcggacgcacgccagtactgccctatcgcgtacgccagctcgagcgtcgctgtgccgcttgtgaactgcatcggatcggatgcgaagtcgtacaccgcggacgcgatcacctcattgctggaatccttgatggagattgtgacgtcttcgcctttccacgcggtgtcaccgcaggcgtgtgcagagaacgcgacggtcgcaatcatcgtggttccgtttttctcgacactctccaagcccgcgtcgggcgttgtcgcgcaatccttggtttgcttggccgcatcgttctgcttggttttgttggattgctcatccgcgttttgcgccgtcgaagaaccgttttgcgccgaatcgtcaccgctattatgattggttgatttccatacaacaaatcccgcgattaacgctatcaccgcaataattacaataattgcgatgatgattggcttcttgcggttcttgcaatcattggcttgcggatcagattgcgttccggactgcatgtctagctgcaggcttgatggcgcgggcatgggaaccggaggatatgcggccgttgccggcggaacatcgatttgagtggtctcagccggctgagcaccttgtgtccccaacggaaaaccgcaggaaccacagaatcgcatatctgcggtgacggcaacgccgcactgcggacacacggaaggaattcccgcagccgcatggccatcctgcaattgcgcggcgccgcactgagggcaaaaccgtccatctccgttccactgaaatccacagcgagcgcactggccggcatactgctgattccgctgctattgcctgccgtaccgttcgtactgttttccgtatcttcgttcggtggtgtcacggcttcggtttccgggcaatcctcctacacgctttccctgttcaatgtcgccagcgtcacccaatacgcttgggcactgtggatttgctttgtgcttttcatcattgcaacgatttacattgcgcttcgtgagacggcccgcaacatgtatgacccgtattatgcgaagtgggagaacacatggaaggctcctgtcgccgtgatggtgttctggcttgtcgcggaattcctgtgcacgaatttccttgccggatacagctcgaatacggtttcgacgatggtgccaatgtggtatttcatcgtcgccggcgtctgggctttcctcgttgaagtgattgcgatgacgtttggtccgacgttggttgcgtcgacgccgggattgtggaagattcttgttggcggtaccgtacagcagactccgcagaacgtcgtcgattacgtcaaggcttgcgatccgcatttcggccaaccgaaggcagccaggaccgcagcttccgcgcagaccgcgcaatacaacgcgcaatacaacgcgcagtacgccaatccgtccgcgccagcaacgtcaccagccgcgcagaccgctcctacgcaagcgatgcccgctgttccaatgccaaccacgccaatcccagcgccagctgcttcggttccaccagtaccgcagtcaacggcttcggttcctcccatgccacaatctccggccgacattccgatgccggccgttccacagggtgaaggaaagccactcgacccaaaaactaagaagacgatcctgatcggctgcatcgtcgccggtgcactgatcgtattgggcattgtctatggtgtgctcaattcgaccgtcttcagcgcgaaatccatggcggaaagctatgtgtcggcaatcgccagcggcgattacgacaaggctaacgacattgccgatcctcaagtgggtaaaaaccaacgcaagctgctttccaacagcgtcgccaagaccgataacgcgaccatttcgaatgcgcatgtcaatggcgtgaaatccggcaatggcacaaccaccgcatcaatcagctactcgttgaacggcgaaaccgtcgatgaggaactcacgatgcacaaatccggcaacaaattcctgattttcccgaactggcaaatcaccacgccactgatcaagtccatcaatgtttccgtgccaagcagtgtggaatcgttgacggtcaacaaggttgcggtcacagccaaaaacgcggagaagacggattccggcgaatggcagttgcgcgtatacccgggcacgtacaacatttccgttacgagcacggattatatcgtcagcgaaacggtggtattccgcacgaacgaagacagcgattcgccgaccacgctgaaggtgacgaccaccagcaagttcaaggatgcattaagcaccgccgtgaacaacgcgctcgacaagtgcgcggaatccaccgactatgcgccggaaaactgcccgttcggcttccgcgtatgggatgaggataattaccgtaatttcgcgtggtcgatcagcgtctatccgaaaatcgacgaagtcgaccttgattatggcgcttttgatactaaaaccggtaaggcaaagtgcacatacgaggtgaaagacggcgattcttgggatccggatgatgatagtacgacgttcaatgcgagcggatcgttcgctatcaaggatggtaaggtcacggtcacgcttgatgacggtggctacaactgatcaaatatgaaaatccccctgcatagctgttttcagctggtgcagggggattttccatgcttaagctcagacgtatctcagtctgaagtcattcgccgtaaccgcaatgaatgcagccatagcgaatggggccgaatcactcagcgacaaccttcacggtgaaggaagcggagatttccgggtgcagagcgacggtcgcagcgaactcgccggtggtcttgatcggatccacggtgatgttcttcgggttgacggcagccttggaagacagcgcgatggcgatcttgtcggcggagatgccaccgaacagcttgccggactcggagaccttggcggcgatttcgacgacggaaccctcgatgagttccttggcggcaacagcctcttcgcgggtggcgacggccttggccagacgagcgcgcttcatggcctcgatctgggcggcagcgttcttggaccaagcaaagccgaggccctgcggaatcaggtagttacgagcgtaaccggccttgacggtcacgacgtcgcccgggtgacccaggtgattgacggacttggtaagaataaccttagcttcagccattgttcaaacctctctcagatcagcgaccggaagtggcgtacggcagcagagccatctcgcgggcgttcttgatagccttggcgagctcgcgctgttcctgcacggaaacaccggtgatacgacgggaacgaatcttgccgcgatcggagatgaacttgcgcagcagggcaacgtccttgtaatcgatctcggtgaccttggcggccttcagtggattcggcttcttcttaaacggcttgaccggcggctgcggcctcttgcgtgacatcttgatgttctccttaaaatctggaaattgcttttcttttaagctgcgatccgggtcggatcagaattccggttcgtcgctgcttccaccaaattcggaggagccaaaggaaccgaacgatgaggaaccggaattatccgaattgccccacggatccgatgccggagcaggctgcacggcgggcgcggcattggctggagcggtagccccaccctgatagccagcgccaccggaatacccggcaccgccctgatagccaccggcattgccggcgaagccaccgttgttgaacccgccgttgccgccagcgaaagcattgccgccacgattgccggcaaaattaccaccgttggcactggaggttcgggtgacctgggcggtcgcatagcgcagggacggaccgatctcatcgacctgaagctcaataaccgtgcgctgggaaccatcgttcgcctgataggaacgctgctgcaaacgaccctgcgcgatcacacgcatgcccttgctcaggctctgcgcgcaatgctcggccatgtcgcgccacgcggagcagcgcatgaacaaagcctgaccatcttcaaactggcccgtattacggttccaggtgcgcggagtggaggcaatggtgaagctggccacggacgagccgttgccaaccgtacggatttcgggatcagccgtgaggttacccaccacagtgataatcgtttcgcctgccatcgttacctacttactttgcagcttgaaaagcttggaattacttacttgcgaagaatcttcgtacggatgacggattcgttcaggttcagcagacgatcgagttcgtcgctggtggccggctcagcggagtagttgaccacaacgtaattgccttcggtcttgccagcgatctcgtaggcaagcttgcgacggccccagatgtcgatgttctcgacagcaccgccttccttggtgacagtttccagatactgctcggtcaacttcttcagaccgcgctcatccagctcaggatcggcaatgaacatcagttcgtacttatgcgcagacatcacccacctccttcggactatcggccatggaccttccatggcaggagtgtgtatgcgtactgccttcacgcatctatatatgaaaggtataaagatacagttcagacaacctgttcagcatagcccttctgctggacgagcggcaattgcgcacgttctgcaacatcatgcgcacgttctgtggtgcaggcgcgtcatgggcacccgcattgttatattgaatacggctatttttgtacggttggtaccgtatttacgcgactctagatttgtggaaggcgaagcatgtcggcgattctcgaaggcaccccggataagaaattggctttggtgacgggtcgtgcgtaccctgagcaggcccatgaaaccgcgaaatacctgggaatcgacgtacttgagaccacggcttacgatttcgccaacggcgagatgtatgtgcgttacaccgagccggtgcgtggcgccgatgcgttcgtgatgcaggcgcacaccgagccgatcaacaagtggattatggagcagctcattatggttgacgccatgaagcgcgcttccgcccgttccattaccgtggtcgcgccgttccttggctattcgcgccaggataagaagcatcagggccgcgagcccatcaccgcccgactgattttcgacctgttccgcgcagccggcgccgaccgtattatgacggtcgatctgcatgccgcccaggagcagggtttcttcgatggaccggtcgaccatctcaccgccactccggtgctgcttgactacgtgcgcaacaacatgccgcttgagaacaccaccatcgtgtctccggatgccggccgcatcaaggtttccgaacagtgggccgcgaagctgggcaatctgccgctcgcgttcattcacaagacccgtgacaccacccgcccgaaccatgccgaagcgcatggcattatcggcgaggtcgaaggtcacgactgcgtggtggtcgacgacatgatcgacaccgcgggcaccatctgcgaggccgtgcgcacactgaacaacgctggtgcgaagtccgtgacgctggttgccacgcatggcctgctgtccggcccggccgtggaacgcctgagaaattgcggtgccaaggaaatcgtgctcaccgacaccgtgcccgttccggaagagaagcgcttgccgaacatgaccgtgctgtccgtggctccgctgttggccgccggcatccgttccgtgttcgaatccggatccgtttccacgctgctcaacggcctgcccgaagacatgcgtccccgcaatatctacgcctgattcgcgcaatcttttcaacgtaacaaaaactcgcccccatccggtcggcgagttttttaatgtcagatcttcccaaaaacggggtgccgcatcctacgtcggtaggatgcggcaccccgcgtatcaagagagaaaagagaaatctggctagcgtccgataggcatcctcgcttccgttatttggcgaatgcttcgcggatttgcgcggcattgccgtaggaggcctgcgcaccataccctgtggcggcgtatgccgaaacatacgaggcaagctcggccgcttcggaaagcgccatgcccgaggcaagaccggccagcaccgtgcccatgaaggagtcgccgcagccggtggtgtccaccgcgttcacacgcacgggggcaatgcgctggatcggcgttgccgaagtggaatccaataccacggaaccatcgccgccgagcgtcacgatcgcctgttcgaaaccgaatccacgcattgcttccagcgcatgattccaatcgaaaccgtcccaatcgtcgttttccggctcgtcaatgccgagcagctgcaccatctcatgctcgttgacgagcagaatatcggatgcttccaccagttcggccggcagcgacggggtgaacggcgaatcgttgagcagcactttcacgcccgcttcatggcacatgcgcgcggcggccgtcaccgtttcgatcgggctttccaagcacaggccaagtacggaagaccgtgccagcgcatcgcgcacggattccacataatccacggtgacctgtgcgttcgatcccggcgagtacacgatggtgttttcgccggttgcgtccacggtaatcacggttgtgccggatggtccgagcacgcggcgaacatgcgtggtgttcacgcccgcctcgcccagagcgccgagtaggaagtcggcgttggaatcggagccgaccgcgccgaacatctgcacggttgcgccgatgcgcgctgcggcggccgcctggttgccggattttccgcccggcagcagctgcagcggaccgccggtgatggtctcccccggccctggcagacgctgtgcggtgacggtgtagtccgcgttcatcgagccgattacggacactgtgccgtggatgcggtccaatgcggagagaacttcagtcgcgctcatctttaccttccttacatcaaaagaagatttatgaaaatggagatttgcgaaatagtgttgttcagtaatcgcaattatcgcaaatccccatttttactatattgaggatgtaatgtgcgattactttgccgattcctcggtttccagcgcatggttgccttcgtagatcttcttcttgaagacgaagaacacgatcaggccaagcagtgcggtaccggcggcgaccagcagcaggttggcatagttggcggcagtgccggttgcgccggtgatggagccgcctgcgagggcgttggagccgagcaggctgccgatgatggcgatgccgatggacggggaaacgttcatggccagatcgttcatgccgacgccacggccggattcgtccttttcaatggtgcccagcacggtggagaccaccggggagtacatgaggccgcagcctgcgtagaacacacatgcgcacagggtcagcaccacgaaaccggagttcacgcagaatgccgcaccggtccagccgaggaacatgagggtgcctgcggtcacgatgccggccttgattccgatcttgcggatgatcatgccggagcaggtgcccaccacggcggcgaccacgaaggcccacacaatgtgcagggagacctgggtggtggtcatgccgtagatgttggtgccgatggcgttgaagatcgggctcagtgcgtagttcacgaagtagaacatgaggatcaggcagatggcgcgcagccagcgggtgttcttgaagaatgccggggtgatgaacgggttggaggccttgttgatgtagaaggcgaatgccacgaacagcagcagggagaccacgagcatccaccatgccatgtacgagaagaacagggtgaggaatgcggtggcgaagccgaagatcacgaagccgaatgcgtcgaccttctggccgttgccgctcttggacggcagggtcttgagcaggatcggcaggaacaggatggtgacggacgggatcaggaacaggaactgccatgcgatggagctgagcatgccggctgcgaacacgccgatggatgcggaaagctggtatgcggcggtgaacagaccgaagaagatgaccttcaaatcgttacgcaggtacttggtggccaccaccaggaaggcggaacctgccacctgttcgcctgcggtctgcagcacgcgtgcgatgatcacggtccacaggtttgcggcgaagaagtagtttgccacgaaaccgaagatggagccgacgaacagcgtcacgagaccgacggtcacaagcttacgcagggagacgaaatcgcccagggaaccgtagatgaagcacacgatgccgagcacgatgctcggaaatgcggtgatcagggacgcctggttcggtgcgccgacgtcggtgccgacctgctggaacaccaggttgaagccctgcaggcacagggtgccgagcacgaaggtgatcagcagcgggatcagggcgcggatggccatcttgttgctggtcaccggatcatcgaacggatcggcggatgcggtgccggtcacgtcggttgtgttgttagacataataaaaatccttgattctctcgaattgcgcgatatgcgatacgcgatatgcgatacgcgattgcttggccggttacgcttattcagccttggctgcgaggccggagatgcgggtcatgaattcgttcaggaagcgcggcacgtcgacgccgacggcaaccttcatggtcttggccgggtcattcaggcgggtttcgtcgccgatggtacgtccgcgggtcgggccttccacgtcgaccttcatattgatgtcgagggtggtgacgagggtcgggtccactgccacgccaacggcgagcggatcgtgcaggccgcagccgcccagatgcggggacgtggtttcgtaagccttgatgtagaagtcggtcatgtcggccaggaacctgccggccttggtgccgaggtcgcgccactgctgggtttccttgtaggtgagcagggtctgcagggttacgtcgagaccgatcatggtggtcggcgccccggaacggaacaggtagtcggcggcttccggatcctgcgaaatgttggcttccatgcaggcgttgcagttgccgggtacggtcagtgcgccgcccataagcacgatttggccgatttcatccttgatttccggtgctttcttcaatgcggcttcgatgttggtcatcgggccggtcggcacgtagacgagatccttgccataagtcttcactgcgtcgatgatgaagtcgaccgcagattcggtttcgacggaacggttggaatcggggatttccacgtcgccgatgccgttgtcgccgtggatgaatgcggagatcggcagtacttcgaagtgatcggcggtactggagtgcggcaggccttgatagaccttgacttccgggtggccgagcaggtcggtcacagccagcgcgttgcgtacaccctgctcgacgagcacgttgccgtaggtgccggtgatgccgatcagttcaatctccgggcttcccagagcatacgaaatggcaagcgcgtcatcaacgccggtatcaagatcaagaatcatctttttcatgtgtgtgcctttcctctttgacggcctgacgacggtccgccaccatacgggtgcgtcgtcagttatacatcgagcgcattctcgattgtgttgtgttgacaagatttatgataaagcgttttattaagaacgcaaattcttcccctatacacggcgtgttgcctttatttccaacgattacagcatattggagatgcctacgtcaccacataccgagattgatctgcaccacccgttttgcaccagtctgcagcatctaaaaatggcggtttacgcgcaggccgcctgcaccagtttcggcgtaagcacttcaacctgcggatcggaaagccacggacgggcatcccctgattccgtaccggacttggcacgaaccgcaacatcaatccgcttacgcaacataccccaacaagcggcggccaaatcagtcacgctctgctcaacggtggtcatacgccaaccaagaccgaatcgtttgagaatattgtcgtaaccaatcacctgcatatcctcagtaacatgcaacccacgctccgccatacgctgacggaagccaagcgccatcacatcgttgcagcagaacacggccgtcgccccgccatcgatgatctgattcgcggcacgatagccgctatcgaaacggtaatcaccctcaacacacagcgaagaatcaaaatgcttccccgactgctcgatggcatccacaaaaccacgacgacgctccgcggcactcgactccgcaatatcgccggtgacaatgccaatacgagtatgaccaccttccaacagatactgggcagccaaacgaccaccaagatagttgtcaaaaccgacggcatcgcaccagccgcactgcgtcaaacggtcgatcagcaccaccgggcacgacacaagcgccacatcctcacacagctgctcaacagcactcccaacacacgactcacgcgccgggatcaacatcaccccatccaccccacgggcaggaagacgctgcaacaacccatgctccgcagcacgcgaatcatcggaattggccacaatcagcgaatacccctgcgcggcgcactcatcctccacacacttggcaagcgccgcgaaaaacaaattctcaatatcaggcacgatcagcgcaaccagctgggactgcttggtcaccaagctacgcgcgctctgattcggcacataattcagcttcttcgccgcgtcggcaatggccttacgcttctcctcagacacgcgagccggccgattattcaacaccagcgaaaccgtcgtcacagacacccccgcagcagcggccacatccttcaacgtcgcacgatacgccattcaaaccccttaaaacgtttctccttccagcataaatgccacgcactcctgacgcgcccagcacccccatccacaaacaaattcctttcatagcaaaataatccacattatttccagtggtaaatcgtttctcagaaatgtttttgtatactcgcaacgttttgcttaatacgaaagccacagagaagagaggaaccccaatgcagccaacagcacagaaaaacaatgcgaaacagcgcaagaccatcgccatcgtcgccgtgatagcagtagttgccattgcgctcgcagccgttgccatcatcgcagtcgccaataagcgcgaaatgacgcaagccgccagcgacacctgcacgttgaacgcgaaggcgctcgccacgcatcagcaaaacttcgaagaggctcagaaagaagccgaagatgcggcaaaactcaccgtggacgacgtggccgacggcaccacgctggaaaccctgaaggatgcgatcacgctggccgaagccgtggaaaacgcgccaacatgccccgcgaacggcaatgccagcgacttcaccaaggcgacagacgatattcgcacgtacgccgacaacctgcgcaacatcaccaacgaactcgacgcggccgccaagtcggtgatcgccagccaggaactcaaactcgagtccgccaagtaagccgtccgagccagacgagccgacagggcgccgcccctagctccgccacccctgcgttcaacggggccaagttgcgttttcaaacaactttgacctcgttaaagatgactttcgcaacgttttcacaacccgataaccgcccataccgcaaatcgataccccttccaaaaaacccgaaagagcttattaacggggtcaaagttacgttttggacgacttcacccctgtacaagcgctttcgcaccgtatctggcttatatatggcagattcgacagtccgaccggaggcatttcctgacgaaatcggctacttgcagcacgttattccccaatcgccacttgccgaacccagttgccaggctgcgccgtatccaccatgacgcaccgtcacaaacgctccagtccgacgcgctttactggccttgggcgcggtagcgggcttcggtggcggctttggcgggctcccaccaggcgcggttggcagcataccaagcgatggtcgcttgcaaaccggcttcgaaatcggtgcgcacaggcttccatccaagttcggcacgcagcttgctggagtcaatcgcgtaacgccgatcatgcccggggcggtcacgcacccagtcgaacgcatcttcggcacatcccataagccgcaggatcatacgcatcacggcaatattgctcatttcaccatccgcgccgatcaggtatgtttcgccgatccgcccgcgtgtaagaatcttccacaccgcagaagagtggtcttccgtatggatccagtcgcgcacgttctcgcctgtgccatatagtttcggacgcacgccctccatgatggaagtgatctggcgtggaatgaatttttccacatgctggtacggcccgtaattgttggaacagttggaaatcgtggcgcgaagcccgtacgtgcgaacccacgcacgcaccagctggtcggatgccgcttttgacgcgctgtacggacttgacggcttgtacggcgtgctttcggtgaatttgcatggatcgtcgagcgtaaggtcgccgtacacttcgtcggtgctgatgtgatggaatcgcacgtcatgcttgcgcgccgcctcaagcaggtggaacgtaccctccacattcgttgtgatgaagggttcaggattggcgatggagttgtcgttatgcgattcggccgcgaaatgcacgatcgcgtcatgaccgggcacgatacgttccagtagtgcagcatcgcagatgtcaccttgcacgagttcaacttgcgattgcggaagaccggcgatattctgcggatttccggcatacgtcagcttgtcgagcacggttatgcgcacgtcaggatggttgtgcgccacatagcgcacgaaattggctccgataaacccacatccgccggtcacaatgatgttgcgcggcttgaaaatctcactactcaccatttcagggtaccggcagggttgcatcatggagcgctcgtgggcgatgtctcgaatcactaattcacgtaacccgcgcaagccgaaaagttcaatggttgcacggcttcccccgtggcggatgcgatatctatgacagattcagcaggtttttcgcactccaaaccttgatttggtgtatgaacggcacctcagttacccttgatttggtgtatgagagcgcctttcgcaacccttgatttggtataaagaccgcataatcattggcttttcaagcagagacccattgaactcaaacgagcaccctaaatttaggtcctggcagaagagaacttctggattacatggcaagattcgggctctaggccaagtatgagtcaggtcccgcttccgcctccagtgaagccgactcgcttgcagcgtgacatcttcaaaagcgacgcttaccgaatctcagttgtcagactgcgtcacatcgccatggcgaactgtcataagcgttcccgtccgacgcacttcacaaattcgtcttcctgaggcttggaacccttatagtcagcaaacaacacttcaaaatccggaacagcaatggtcttcatacgagcacaagttggaacggcatgttcagcagcaatatgtccagaagtcggaatagtgcgttcatggtctgtcatggcaaccacgttacatctcacgtcaacggtctaactgcgccaagccacgcaccgaatccgccgcccgccttctcgtcgccccatacaagccacgctttcggcgcattatcagctggtggcatccaacacttgcgcgcgcatatagtcgtccaccttgaacaccaaatccgtctgtcgactgtcgctcgcagcaaattgagtaaaaagatccacatatcgagcctctcccccagtctgcaaatcaaccaattcctgcgctacgacccttcagatttcgcatacattttgttgccctttcccacttacgttgtaggcagataccccacgtagcacagttaaccttccagctacctttcagacatctacgagatacccgttcgtccacagctgaacactaaaatgtatccggtttaattgtacagagcctccaattataagggggctatctttttgaaggatgcgacgatgcctattttttcgcctgaccgtcatgctcacgttccttcatacgtaaaacttactaagcagccgattgcaggtggaacatatcgccctcttgcgaatgacgaagacagcaacgcttgcgccccatccgccctttcaagtcaccatagttcaaaactgtatacgcagaagtcggcaattcacgccacctccgacaacacaagcatctttatttcaggcgctggcaccctgccctgtttaccggagatggtttccagtggatccgtcagtaaagccgaaatagacaataacgaacaaatcgcttcttctgagctccagccccatcaacccgctgagcagcctttgaatcaggtcgtctcggtttgcaaacgagccgcacataccacggcaaaaacgctttccaccgcagggcacacggctgtaaaagcaaccaaagttaccggtcacgccgtccataccgccgccacagcggtaaagaccgcatggcaaactttcaccaacttcaaagccattcaactcatcatcaaattcttcaaaaaggcgtatggcctctggaagaaacgtcatcgcttctcattctcgttctacgccattgttctcgtattagtcaccgcttttgaggtcgtttttcttcagtggggcatgtacagcgagccggaatatcctgaaggctcggaaattgacgatacgaccagagttttgcaaagtgttattgggcgcacgacaaaattcgttagccagatctggattgaccatcaataccaagcattactgaatttcatagttctgggtgttatttaccttactctggtgctgattctcaatcgtttctgggttgcttcagccatctttggcacagttatgacagtatttgctgtcgccaatcacatcaagatcgagtcccgcaacgaacctgttattcccgccgatttgaacttcatcacaggaggcaatgcgggagaactcacttcctttattccaaattccagtcaggctctagttgacggtgcggtagctggcgttatttgctttgtggccatctgcatcgtcatgcaattccttgatggcagaaatgcagtcatcccctgccactggctacacccgtttgccagcgttaaaaattttgccggcacgattacgcgcattttggcagccgctctcagtactgcactcgtattttccttcgtgtggggactcggagcagacgattcctgggctacaaaatttgcccacaatctttccgaccgcccccagccttggaatccaattgctgacgctaccagcaatggtcccgccatcaatttcctccagcttgcacataccaagatcatggataagcccgaagattattccgaagaaaccatgaccaagattacaaagaaatactccaaggaggctgattccatcaatcagtccagaacaaccaatctgactgataacaccgtaatcatggtgctttcggaaaccttctcggatcccacacgagtaccgggcgtaagtttcgccgaagatccgatgccaaatattcgacagatcaagcgcgaaacaacatccggtcttatgctttcccccggctatggtggcggtactgccaacatcgagtatcaagctctcacgggtctttccatggcgaattacagcgataccctatctatcgcctatcagcaattagttccgggacaaaagtgggatcagtccctcaatcagctatggaatgaaaagaatggcgaggactcttctgtagcctttcacgcatacaaccgtggaatgtatttccgcgatatcaactataagaagttcggattctctaaattctacgccacggacggaacacccaagctcacagatcttcatcctatagattcggcttggtattcttccgatgaatcgttctatagccaggtgttgaaacaggtgcagtcctctgactccaacaagttctatcaggttgtgactatacagaatcacatgccttatgaggaggatttatacacagataatcagttcaaagaacttgatacttccgaaaatcttcaggagaatgaacgactcaatattgagacttacactaagggtcttaattacacagatcaatcaacgttagatttccttaatcagctcaatgacatcaatcgtcctatcactgttattttctacggggaccacttacccggcatctatagcactgcctactccgattcagacaatattcttggtcttcacgaaaccgattacttcatttggtccaataatgcgtcttctgctgctggaaccaaacttgatgacgcgtcctccgcatacacctcatccaactatttctccactcaacttgcttcacatctcaacgcaaaggtgagcccttatctggcattcctgacggaaatgcatcaagccatatctgctatgtctgttccttcagcagcgggaggcagctctgaagaaccggtatatctcaacgctgctggagctcgtatgagtaagaaggatctttccgaagaggctaaaacactactccatgattacaaactcattcaatacgatatgagtgccggtaagaattaccttaaagacactaatttcgtagagcttcagtagattcgtgttcctcatcaccgccagtttctacaatagtgctagtttgtcgagaataacgaaagccggtaactatgaaaattgcagttgcaggaactggatatgtaggtctttctgtcgctttgctgcttgctcagcataatgaggttcatgctttggacattgttccggagaaagttgagcttctaaacaacggtaagagtccgattgtggatgctgtgattactgattttctggagaagaacacctccggcgagcgtcctctggacttccatgcaaccgttgacccagaagaagcatattccgatgctgatttcgcagtgattgcaacgcctacgaactatgacgagaaaaagaattattttgatacttccagcgtcgaagctgcgatttccgcagtacgaaagtatgcgccggaagcgtggatcattattaaatctacgattcctgtcggatacacgcagcagctacgcgaccgtttgaacgatgatcatattctgttttctccggaattccttcgtgaaggtcacgctctgtttgacaacttgcaccccagccgtattgttgtcggtgctccgcaggatgacgcacgttccgtagaggccgcacgtacttttgtggatcttctggctcagggagcagcccccgaagaacgctctcgagtcaatcatgatggcagtacaggcattccagaactggtggtgggcactaccgaggccgaagccatcaaactgtttgccaacacgtatcttgcgttgcgtgtggcttatttcaatgagcttgacacttatgctgaaagccgcggactgagcactcgcgaaatcattgacggcgtttgccttgatccgcgcatcggcgacggttacaacaatccaagcttcggatatggcggctactgcctgccaaaggacaccaagcagctactcgccaattacgatcaggttccacagaatctaatcgaggcgattgtggatgctaaccgcacccgcaaggaattcgttgcttctgaagtgatggatcgcatcaaagatgtgaaagatccgattgtcggtatctaccgcctgaccatgaaatccggttctgacaacttccgccagtccgcgattcaggatgttatgaagcagttcaaggcaaacggcatcctcgtactgatttacgagccgacgctagatgccactgacttcttcggcagcgaagtaacgcacgattttaattcgttcacggaacggtctaccgtcatcgttgccaatcgctggaatgatgaccttaacaaggtatctggcaaggttttcactcgcgatttgttccgtagagactgacaattcttttaaagccctaatgaatttctagggcacaactaggaggggcgtctggtgcttgtatgaaccgcaccccgattgttggactgaggaaattcagattcgatgatcggaggtgcggttcatactcagcataacggctcctcggtaatcttctctcatgcgatagcgagacactattgttccactactccatctcctaccgtatcccctttccttcatatgcgacaagataaatgcggttttgaaaggacaaatgtcaaaaatgctgcatccgcaggcagattaaagcaattcggcaaaaacaccaatccaccaaatgatgtgacggcataagccaacacacccatccgaatctacaccctacttaaaataagggggtaaacactttgatgaactagctaaaggagcacatcatgagagaaaagaagaagcctaagaagcggatattatgcgcgataatatcatgttctttgttggcaagcataggtttcgcgcaaccggcgagcgcagctgacaccgcagtagacacgcccgcagtccaagacgacatcgagacaatgtcttattcagatggcacgtcgaccggtacttcagagcttaccggagtgtcactgggaacaggaacaaccgtatacgcgaaacaattcatcaaccaagtggacgtctacaactcggcactgaatgaagtcgtgaaatggcgtcgagacgcgctcaacgacaaacaagtaactttcggcgtctacaactggcagaccaagcaaaccgattactattcagtatcggattacctgaagaaacttggaatctccgaaaacgaatatctaacgccaaaatggtctaatgcgttggaacgaatcgcaattcaacgagcgattgaggcatattctgcagaggatgcgcatactcgacctaatggagagagctgcttccgagccagctataacaaaatccaatcagaggcagaaatactcgcatggggtcctgccaacatatccggcgcaattgatttatgggccgaagaaaagaaagactacgtccaaaacacaggagctgaagtcgggcattatcttactttgatcaatccaaactatgagtattatggtttcgctgcaggagatggacagtattacagaacaactttttctggagaggcaggaactcgcagcagtgccgctgaatactcggattcaactccgacgaacatgcgaggcctagggcaattcgaagtcaacgtggatgacgatgatttacgagaaggggctacttggaacctgtcatcgatgaagtctggatccacgcaaaccgcaaaagtaacgctgaagcacaggtccggaagatatgagttcaggggcacatggggatcttccaatgcgaatgtgattagcgccaaccaaagtggcgtatataccgcggggaaggtaggaactgcgaaagcaaccgtttcttctgggtctttcgctttttccacggatgtcacggtcatgcctctcactttgaaatatgacggcaatggagcgacctctggctatgtagcttcacagacaggatcccacaatgatgagatcacagtggcgaagaatggtttcagccgatcaggctacactttctcgagctggaacaccaaagctgatggtaccggcacttcatatgcacctggatccaaaataacccttcccgctggcgataccatcttgtacgcacaatgggttgagaatccaaaactgacgagacttgccggacagacacgctatgacactatggcaaccatcgttcaacacgaacagacaaaacaaggacaaaccgtcatcatcgcttctggagagaattatcctgatgcactctccgcgtcaggcttagccggaggattagctgcaacgattatgctcgtcggatctaactctctgcccagccaaactgctaaccgtcttgcctcacttaagccgaatcgaatcatcattatcggcggtccaagcgcaatttccaaaaatgtagaaaacgcactccatcaatacagctccacagtcaccagatattacggagaagatcgttatgaaacctctcttgcagtattcaaggcggggcagaagctgggagtaaaatggaattccacagcgctaatggcaaccggagataactacgcggatgcgctctccgcgtcttccttggcttacgcgcagaagatgccgattttcctgtgcagttcagcttcaggattctcttcatcccaactggatgccatcaacaaaaccatcaaacagggtcttgtaatcggaggcaccagcgccataccaaattggattgtcaacagccagctgcagcagcaaggcatatcaacaaaaagaattgccggcgcaactaggtatgagaccagcattgaaatcgccaaaagcgcagagcggtatgggttgaccgctgaaggtagcgtcttcgcaaccggcgccaacttccctgatgctctggctgccggaccgcttgccggaaagaaaaacggattcctgttgctagcggatccttttggaactacagctcagtttgttcaaaaatacaagaatcaagttaaaaccgcttacgtagttggcggagaacaagctgtttcttccaccacggctaaccagatagcagatagtctcggtctgcgtcatccgtaagtttcgtagataagagaatggaatggcgggatgccagcctaggctggcatcccgccattccatttagtgagcaaacaccaccattgacttatcagatacggcttgttcctaagcagtcaatatgaagcgccttgtcattaagaagccctgcgaaattagtagttcctggatttcgaaccgagaagtagcatgagttctcatcactcgtaaaagcaagctgctcaaacttcctcagatttgacgtatccggaatcttgcgcatggtggcgataatcttaaaatctccatcattgaatatgctcagaggcaacgcaaagtgaatcttgttatgcccggcattgctgaatttaaaagcgacaccacagtcatagggcacaccgccgcgcttgacatccaagaccgacataggaatgtagaattctccgccgtcactatcacgaagatcatattcgacatcaaattcgaacgtctcggcacaggatgaaatctgcggggaaacaggcagaattcggaaagtgggcaccttctcactcaagcctagtgaatattcatcttccggattttcttttcgctctttatgctcagacttgagattttcgagagtataacgatcggcaacatcgttcttgtcaccactggcgataatctcgccgtccttgatcaggatggccttgttgcagtacttcttgacggaatccatggaatgggtgacaagaataacggtcttcgttggatctttcttgatttcggcgaagaagttgtcgcacttacgctggaatgcttcgtcgccgacggctagaacttcatcgagaactaggatatcgccttgagccttgatagcaacggagaaggcgaggcgcacctgcatgcccgaagaataattcttgagcttctgatccatgaaatcttcaagctcggcgaactcaacgatgtcgtcatacatcgcgtcgatttcagcacgagtgaagcctagtagagcaccgttcagatacacgttctcgcggccggtcaactccggattgaatccaacaccaagctcgatgaatggcaccagcttgcctttaaccgttacggaaccatgttccggagtatagatctgagaaataatcttcaacagcgtggacttgccggaaccgttacgcccgacgataccgaagaaatcaccttgacgaacttcgaagttgatgtcacgcagaacatgctgctcggtatagcctttgatgcctttcgtccaattcagaaaggccatcttcaagccagtagcctgttctgtaggcagacggaacattttggcgacatggtcgaccctgagcactacagggcgctcgtcaacgtttccctcttcagtcattgcaacctcagtcatgatttagagcacctccgcgaacttggaactgtacttacggaacacgtgaatgcccagccacagaatgaaaactgacaacgcatacggcagcaagcaaagcaacttgttatcaaccatgctccacacagtcggcacatactccggagaaagcagattatgacgaatatccataatcacctgagtggaaggattaagcatcaaaatattggcggcccagccgtaacccttatccgcaatcatggaaattgggtagatgataggcgttgcatagaacatggcctgcaatatgacttcccaaatatgagccacgtcacggaaatacacgaacagcgaagcaagcagcaaagctacgccaagaccaaggcaatacaactgaataatgctgagcggcacaagcaatactcgccacgtgtaatgcgcatgggcgaagaaaccgaagcagatcaccacgagcaggttgatgccgagagaaatcatagaacccatagtggtggaagccacaataatgtagttcgggaaatgaaccttacgcagcaaatcaccgcggccaacaatggattgcatacccatgctagtggattcggagaagaagctccacaagcaggtaccgcacaacaacgaaatcgggaacgtcggggtgccgtcggagaacttcaagaacttcacgaacaccacatacatcacagcgaacaacataagcggcttcaacacggaccacaccatgccgaggaacgatccttggtaacgcaactggaaatcggttttcaccagttccttgaataccactatcgcgtagtggtacctctttttgaggctgtcaaaaaagttcttcacaagcgtcctatcctactagtgcgaagtatttgagcacaaaaacgtatagcgtgcccttcttcagcagtactttcatatattctattgtggaaaggacgtttgtttcagtaaggcggaatatctcacatggctctcacaggagaacatcagcatccggatatcaaaatcttcgtgtcggcacacaagcctgctgttttccctgaaggaaacagcatcctccctgtacaggttggagtggcccatgccgcaaggcggttcgacagcacgctgcatgacgatgagggtgagaatatttccgataaaaatccccgttactgcgaactgaccgcgcaatactgggcttggaaaaacgaggatgccgactactacggtttctgccactaccgacgctacttcgatttcaccgataccccgcatcaggaaaacgactatggcgaaatcatcgattcctatatcgacagtcaaaccattgaaaagtatggcatcaacgatggcgatatctccaaagcggtagatggatgggacgttatcaccacgccgcttaatgacacccgtcgtattggtgggtttacgaatctcaagcagcattgggatgcggataggcatcttcgcctcaaggatttgcgtcacatgtacgacattctgtgcgcacgtcatcctgattacaaagcggatgctgatgcggtgctgaatggccatactgcagctttctgcaacatgtttatcatgaagaaggatattttcttcgagtacaacgaatggttgttccccctgctggatgagtttgccgagcatactgatttcagcaagatggatgtgcagactactcgcaccgtggggcatctttctgaacgtttgcttaatatttttcttgcacataagcagcgcactggagccaattggaaaatcaagcgactgcagtgcgtgcattttctgcatccggaaccgttcgccaagcttgaaccgttgcaggagaatcctgaaaccattgtgcctgtggtttttgcagcggacgataattacgttccaatgctcactaccacgatatattcgatgctgaagaacgcttccgaagatcgtttttacgatgtgatcgtgctggaacgaaacatttctgacgagaacaagcagattattacgaaattccttgcgcaattctcgaatgccgccgtacgtttctatgatgtgagccgatatcttgcaggattcaatctcaccaccagcaatgcgcatatcagtgtggaaacgtattatcgtttcatcattcaggaagcgttgcctttctactcaaagctgctgtacttggattgcgatcttgtagtgaatggtgatgttgccgaactgttcgatacggaaatgggcgataatgctatcgccgcagtgccggatatcgacttcatcggcaatctcaatatgaaggatggtattcgcgccgagtatgtgcgcaagcagttgcatatgcgtgacgcctatggatatttccaggctggcgtgctagttatgaatttggatcgcacgcgtaagattcatacggttcatgaatggctgcagattgcctcgaagccgggatatatctacaacgatcaggacattcttaataccgagtgcgaaggtcttgttacctacctcgactattcgtggaatgtgatgcataactgtgctggacgtgtggcgggagtattcgatttcgcacctgcagacgtgtataaggcatacatggaatcgcgcaaggcgccaaaggtcgtacattatgccggtttcgacaagccttggaagaatccttggtgcgatttcgctccactgtattggcagtacgcgcaggaaactccgttcgttgcgcaaatgtacgccgccatgtcgggagtgcagaagccggaacctccggaacatcatgatcgggccattgctgaagacagtccaatccgtaaatatgtggatgttttagcccccaccggatccaagcagcgcgaactcatgaaagtcgtagcgcgcaaggtgcgaggcaagaagtaaaacaagtagcgctaccggtcatccgcgtatgtgttggggctgtccgttcctttaaggagcgggcagccccaacacatatctctgaatgccctcacgaagttgcttagtttgtcagagccaaaccaagactcttagaaagccggccggcagtgttccagctaaccgcattagctcctcccaaaatgtacgcttcagacacagattccgcataagaagacacatagcttcccacattggatacggttgcatcgctgttgttcaccagcaacatacagcttgcatcacgaccagccaaaggacctccagataaggcatctggatagttttgccctgtagtgaaaacaacattgttcatagtcaatgcgccctgtccgatagcccagcgagcgaaaagaatactcgtattataccgagtctgcccagcaatacgaattggtttaatacctaccgtctgctcgatttgagccgagacaaattcaggaactgcctgagcccctccaacgattacgatttgagtaaagttcccatcctttaaagcattctgctgatctgctgtaagaccagtctccgcatcagataagaacaccggtgccttctgagcatacgcataggatgtcacagatagtgcatcagcaaatccgttttgattatttcctccagtaacaacaaccgcggtttctccccatccagcggacagactcttccccgcttcataaatttgcaatgccgtatctattcgtgtggcaccctgaattcgttcaactccgtcaacgcattgctttaaagaagactccacatcagaggaaaccgctttttctccaccgacaataacgacggaagaaggcttcaagcgctttatttcattacgtacgttggcactcaacacctgtgggttcgtcagaagcacaggagcattttctatgccggcaaatccggaaacagccaaagcatcgggataattctcacccgaagtgacaataaccgtcgaagtctcctctggaaaagcagtgtcgacaacatccgtcatcgtgtcgtaccgattatttccaaacaaacgaatcatttgcccatgcgtatcgtccggagtgggatcaggattcggtaaaggcacttccggagaagcgttattcccgttgtaaaccgggatagtttgcccggacggacactgagacaataccgaccgcattgcttctttctcagcagtgtctaccgaaagaccgtagtgttcttttattccgatttgacgactcacatacgagcagtcatagctcttctgagaaggaagccagttcgctgcatctttatccgattttgacgcattcgccgctccttttacggccagcaaaacataaggatcattggcataggcaacccgctgattctttgtccaagcatcagcgccactttcatacgcctcccctacggcaacgacatgatcaatctgaaccttattagatgtactctgccctctttgaaaatagattgtttctccggtgtacgggtcatgcagtgttccagtattaacatgcctttccgacgtgaacgtgacattttccatatctctctgcaaaatatagtcacgagtagtcgcgctacctccaagctcatcattgtggagccaggttccgaataaatcctctctttccgaggaacggtaatcatctgactgcgctttgaccattaatcgttcaagagcaaccgacgcattttccccctcatcagccgcagctgggagcgctgcaatcagtaaaccgaataaaacaaaaatacaaaccataataggaatgtctcttcgtcccaagcgtctcatagaaccccctcaatctcagtcggcgacccgaatctccacattcaattcaacacctttcaaaggtataatcgctctaggcacaccgtttgaggagagaaatatgaaatcgattcataacaaagttcgaagtgtgattgccgctatcgtatgtgtattttgcactctagcgcttatccccacacataatgcatatgccagcgtcaactcattcacccgaatcgcgggcaatactcgctatgaaacgatgtctcagatcgttgaacaggcatttcctacatcgtctgagtatgcggtgcttgcggcaggaagcaacttcccagatgcacttgccgcttcttctctcgctggagcctataacgcacctataatattgacggattcctgtagcctatcaagcgaagcttccttcgagatgcaacgtctcggagttcgcaaagtctttatcattggtggacaaagcgctatttctgccgatgtggagcagtcaatccgtcagattcagtcctccatggaaattgaacgaatcgccggcagcacccgttatgacacagctctgcagatttacaacgctttgacctcctcaaatacgagaagccaagcttccaaagtagcaatcattgccacaggaaacagcttcgccgacgctctttccatatcaccttatgcatatcagacctcttcgccattcttcctcagctctccttctggtcttgacccagattcccttcagattctggaatccggcgcattcaattccgtcattatcgccggaggaacggcagccgtcccacaacatgttcagacgaatctggaagcactgggaatcaacgtaactcgcttatccggaggcactcgctatgaaacgagtaaatcaataggcgagttcgtgctcaataacctaaattctgcaccgcaagatgtggtattcgccacaggatccaacttcccagatgcccttgcaggcagcgcactatcaggatcgaaaaagactgccatgctgcttgtgcaagacagcaattctccgactattgattttgcagcgcaaaatatttcctccgcgcagaacgtctacgttctaggaggaaaaaatgcagttaactcgtccacgcttaatgccattgcgcgagcatatggtttgggggatcaggaaagcgagccacaaccgccagcgccccaacctacccctcagccaaacccacaagtaggcactcatgatgctggagaattctgcaagaaagcagatgtcggcaaagttgaatatgcgaaaaacggcagactgatcgtttgcgaatatcgaaataacaataaaacaccacattggcactatgtatagcgcaatgaggcattagatgggttgggtgccgcaaggctggactttgtggcgcccaatccatctaaactaatcaaagatattgatcaagctcatcatcccgaacaagctgatcaaaatcagctgtcaaggcatggcggctcttcatctcttcaagaattgccgcaagcacgatgttgttcacgccactttcagtattctggtggcacagggcttcctctccttgcgtgcccggaacataattaagcaattgatcgcctgttgcagccacaacaggcactcccgctttgacttgcatcacttttagccacaaatcatccgcagtgagacacagtttttttatatcttccgcattaaaagtttcagacggcataaggtgtggtgggtacaaggttccggcaccatttgtagcaaatactctcatcgaaggctttcctacaagatctggatgataatggggagcttcgtaaatccactgctcgtacggagtgcatgaaccttgttcatcgaacatgatgagatgggttctcacggctacgattgctttcggatgccgttcatgcatctccatcagatcaccgatcattgtattcctgtacaataaatcgtcatctgttgtaattacataatcatctttgaactcttgcaaagcccaataatatttcttatgcggtttgagatcattgttcacccaacgcacttcaacatcatgccagagaacgtctttcaacgattcgggaagatcatcttccctatttggaaaatcactttcacatagccaaagaataattttgtccggcaatcttttttgagcaagcaacgtacgaatagcaaagtgaacagtgttaattcgtgccggatacgaagtcatggaaactatgattcgaggatgccgccggaatacacgagctagatgcgttccagcacggcgaagcttgttcttcttctcaccaacccatgtcaagtctaccattatgactgctcctcaagttcttaacaatgctctacagcaatgatacttatatacgctgcttttcagagtcaacggatacactgttaacagttgcgttagtagtttgcccaatcgagggagagttatgccgaagatctcaatcatcattcctgcatacaatgtcggcaaatacatagaggaatgcttggagtcagcacgaaatcagaccctcaaggatatcgaaatcgttgtcgtcaatgatggaagcaccgataataccggcgatgtcattgcccaggaagcttcaaaagatagccgtattcaagtggtgaccaaccaccccaatatgggcacacaccgcacccgtatggcgggagccgaagccgctaccggagagtattctttcttcctcgatggtgatgatgcgctcaagccagacatgtgcaagcaacttgttcaggagctatcattgcatcctgcagatgttcttcatttcggcatcacagtagtcggggcaaacgaacttctggattccgagcgcgaagccttcgaagccaataacaacgcgtctacgcaggatgccgtaggcgaggacataattcgcgatatcttcgacgaatctcgaggatataaagtggactggcgagtaacccagcgtctgtacaaaacgtctgtccttaagcaggcttttgcagcaatgaccaaggagcgtctcggccgttcacaagacggatatgaatgcttcgttgtttctgcctttgcaaagacatatcactcatgcaagcattgccgtggatatatttactactacggtcgcggtatcagcggaaccagcaccattagcgctgagaagtacgcgcagtattgtcatcatttcaaggccgattttgacgcagcatacgatttcgccgacactcagcactcagaaatgcttcgcgcttgcgctcagggattccaacggaaagcaacagaaatcctcgctaacgactggaaaatccgaattccggaaaacgagaagctttcagcggcacaaagcatgtctgacgtatttggaccggcaattgcaggtcgagaaatatatcgttttgtgcgggatgacgcgtatgaaaaactgtctgaaaaaacagcacttctgcctaatgacagactgaataactggtttggtattgccaattcgtttgaggttctcccatcccttgaagatactgatagccttcgtttccatgaaatgaaacgtatcgcaacatcccacatgcttgatttagtaactcaaagtgagcaaaccgaacaaatcgaacgatacaacaaccagcgcgttcgcctgttcgtcaccacgcataagaatgtgaatcgatttgagagcgatatcatgcagcctgtgcaggttggcctgcacgaaggcagctatcgtttcccctgggcgttccacgatgacgaaggcgagaatatctccgaccgtaatccgcgctattgcgagctgactacccaatactgggcttggaagaatgtggatgccgattattacggtttctgccactatcgccgctattttgatttctctgacactctccacaaagagaacccatatggcgaaatcatggatgattacatcgatgccaaagctgcgaaagagtatggacttgacgatacaaacattgagcgagtagttcgccaatacgacgtcatcaccactccattcggtgatctcacgaagattatcgacaagcatggtactcctcgcgcattgtgggaagccgctcccctgctgcacgatgatgatatgctccgctgttatcggattctatgcaagatgtatccggattacaaagaggatgccgattctttcttcacgggcaacaaggcatgcttctgcaatatgttcattatgaagaaggagatcttcttcgactattgctcttggatgttcccgattcttgaggagttcgataagaacaccagctatagtgcctacagcaaggaagcgttgcgtactccggggcacctttccgaacgcctgctgaacatctatttgatgcatcataagcgcatcggttccaattggaagttcaaggagcttcagtgtgttcactttaccaatccggaacccgctgaagagctgaagcctcttgatatgtttgacaagccgatcgttccagtcgtgtttgccgcggatgataattatgttccacagctcaccaccacggtttattcggccatgaagaatgctgatccgacatatttctatgatgttgtgattctacaacgaaacatcgcttgggataagcaggaacgactgcgtgacttcttcaagcagttcccgaacatgtcattgcgattcaccaatgtggagcgtgagctgtctggatacgatctttccacgaataatgctcatatcagcatcgaaacctactatcgattcctgatccagaagctattgccgttctacgacaaggtgctgtatttggattcggatatcgtcatcaatggcgatatttccaagttgtacaacaccgacttgcaaggcaagctgctcggtgcgattcgagatatcgacttccttgccaacctcaacgtcaagcatggcaagcgcatggggtatgccaagaatgtgctgaagatgaagaatccttacgattacttccaagctggcgttctcgtgctcaacaccaaggccatgcgcgagcgctacaccatcaagcagtggcttacgtatgcgtctaaccctgcgttcatctataacgaccaagatgtgcttaacgcacactgtgagggagaagtactgtatttgccgtgggagtggaatgtggttcacgattgcggcggacgtgtcggcaatctgtttgtgcaggctccgaacgacatttatgacgcctacatgaagtcacgcaacaatccgaagatcatccattacgctggttttcaaaaaccatggaccgatccagattgcgatttcgcctccatctattggaaatacgcacgtgaaaccccgttctatgagcgtctgctcaagcgcgtggtgaaggcgaacgaaccgaaaatccctgaagaggcgcttcgtccaaagcacgaacgcgccgttggagaggataaccctattcgcaagattgtcgatccactcatgccaataggttcccgccgtcgtgccatggcgaaggccatcggtcgcgcggttcgaggaagggaataatcgcattgaaacagaccacaaaaagttttagaattaccgaacataactttgcttatctcgtccccattcttctgggtacgttgtttggcatgtgttcttttattggccagcatgagggcaaaatcgacactcgaaatgcgctgctttatgtgaacactctcttttatattgccctgttcacattactgtttttcgctgcgacaaaaatagttccgcgcataaatcaccataacgaatcactgaataaaccgttcggagcgttccgcaaactcacattggactggtctcctcgatccattatcacattatggtgtctcgtgacggcattctggattccgtattttgtagcttatttcccgggcgtctactggtacgacacttcttggcaactgatggaatattatgacccttcagtgccgttcaccgatcatcatcccttcatgatgacgtatttgtatgtcggattcgcacatattggcaaagcattgttcaataacgctacttatggattgtacctgctagtgctcgtgcagtcgttactgtccacattggccatcgcttgtacagtctgttatacaggcaaatacaacataccttggaaatgccgtttctttattgctgtatttcttacctttttccccatcatccccatgatgtcgatgtctcttgcgaaagatactttcaatacgccatttttcgtattcttctctatcgcattctgtgaactttggagaacacaggggacaattttaaaatccgtttcatttgatgttttctttatcgcagacgcattggccgtatccttaacaaaaaaaacaggcatgtatatcattgtcctggctctgcttcttttggcatgcttcgttgtcaaacattggtcctataaaatagctactattgttttaggtggtgttccttatttagttgttggtataatcgtgccaacttttatcttgccagcattgcacattgcaccaggagaaagtaacgagattcttgctgtgcccatgcaacaagtcgccaatgtggtgcataaccataaggatgatttgagtgtagccgaaatcgacgaaatccaacaaatttaccatatggatattggtcaactccaagatgcttactgctggtataaagctgatccgataaaaggacaggaattatcttctaaagatgaacatgccttaatcacgacgtggacgaaacaactggttaagcatcccggcgacatgatagcaggatggggcgggctctccgtcgcatggttctcattcaatgtcgcatcaggagaagaacaagacctcagcatgatgcgtccaatcaataattccaaacatcattatcaaaacatcgaacaatacatgccttggacagataatactaaagccggtaatgcgattggacaattctacgcagacacattatcagcgacgcctatactcaatatcatatggcaaaaagccttttgggctacaatacttccttttgccatcatgtttctcatactgagatccaagaagaacaaacttaatctgttgatgcttaatctgccaatgttcatcacaatgcttgttctatttgctggaccgatttccacgcacacggaggcaacacgctatgtgttgcctatgctgtatatcattccactgtttctatcacttacgctgaagcatttgcctgaagaatcctaaatcgtctctccggacgtgagtcctacgctgactcacttcgatagtagggctcgtttcacctttgagatgcaccacttgccgacatatacggcaatgccagtaagcagatagaccgcaatggccttaatgaatgggtggtattgcccaaacgtcaggatgcgctcgaaaggcccaccaagcgtaaggttcaccagcagtaggtggaacatatatacaccgagcgagacgctggacactttgcgaattatcgacttcattctgtcagatccacgctgaagggatggctccagcgctttgcagagcatgaacagtgataccgcggatatcacacataacggagaggaaatgccgacaagataattctggtattccacctccatcgaattctggaagaaaccgttccaacataaaccgccgaggaacatcaacgtcacagaaccgaggaaagttgcggcccatgcaagcgcattccaatgcaacggcaagccgtagttttccaaataatatcccagcaggaaatacagcagggcactggaagcaaatagcggccagctcaacaatgggctgaaatattcctcgttgattccaatggcttttgctgcaggaatcagaattgaacagaacagcgtcagtgcaatagcatattccaacaaacgacggtcatggacgatttttgaaagcaatggagtcaataagtacaaatagatgatggtatacaggaaccagtaaatatcgataatggagttggtaaggaatctcttgcaaaaatcgacaggaccgaaaccatcggcgattgattgcgctccataaaacaggccggggagcaaaccgaacaataaatagcaagcgatgctgcccagaatcaacgcacgtcccactcgtacgaatcgttttttgaaaaacactttcgtagaatatttcttccggtaatccaaaagattcattccgctgaccatgaagaaaataggcacggcgaaaataaacatcgcctgcatgagctcttggaatgtccatagaaaagtatgttgcagagagaacacacctaaagacgtatgcagacataccacggcaaagcaggaaacaatgttcagcacgtccacaaatacatagtgagtaccgtgacagctgctttcccgcctgtcgacagagccttgccacatatctgtttgtctcgccgtcactgatcgtcctttccttctccaacttgcacgcccttagcatatcaacgctaaagtatctccgacagaagcggaaactcatccgcaggcgtccgctctcatatctaatctggaaaacacagcatctttatctacgaatcagaagtccgagacatgaaaaacaagtttggaaaccgctatactcgcgccatagcaacgttccactttcataaatttgttcagatgtttagaagaactttctcattgacactgtcattcattctgttttcctgcgtacgctcaggaaagcaagaaaacaccacaagaaaacggaaacaccgcccttcctttaccgagctgtgtaatggacagcatggttctgcaacagaacaaaaccaccaccttaagcggctcagctcagaaatcctcatcggggaaaacaatttccgttactttgcgagaaggaaaacataaatacgccagttcttcaacaatcgataaagcaggaaaattttcaatcaagttgcctagaatcaaagggtcacttgcccaatacaccatggaatttgccatagctgccaccgtgatgaaaacacggtacatgatgtatgcgtgggcgaactttttatagccgctggccaatcgaacatggagatcaactataacgattatttcaaaagcgattcggcattcaagacgaacacttcgtcacgctacactcgtgataattaatgtgaatcgataaatccatttgcttcaagtatgcaacatcacctataatccattccccatgcagaccagtacaagggatatagtggagcatatgcctgagaattcgaacgtttccgttgcagtacttcttccttgctataacgaggaagtcaccatcggcaaggtcattcgtgatttcaaaacgtctttgccgcaagcagacatctacgtatacgataacaactcctccgaccgcaccgccgagatcgcggcggcggagggggccatcgtccgcaaggagccacgccaaggcaaaggcaacgtgatccgagccatgttcgaagacatcgacgccgatgtgtacgtcatggccgacggcgatgacacctacccagccgacgcggcacccgccatggtcgagaagatcgccgaaggatacgacatggtgattggcgacaggctcagttcaacgtattttcaagagaacaagcgcccgttccacaacttcggtaaccgtctggtgcgcggttcgatcaacggcctgttccatgcgaacgtcaccgacatcatgaccggctaccgtgccttctcattcaccttcgtcaaaacctaccccgtgttgtcgcgcggcttcgaggtcgaaaccgaaatgaccatccactcgttgaacaacaacctgcgtctgttcgagatgccaattcagtaccgcgatcggccggctggatccgtcagcaagcttgacaccgtaggagacggcatcaaggtgatgagcaccatcttccgtatgatccgcgaatacaagccactgccgttcttcggtggacttggcgccatcatcggcatcatcggcatcatgctatgcggcagcgtaaccatggacttctggcacaccggcatggtggcgcgattccccacacttatcggcgcggtcatgctcgtcattgccggactgctattgttcatcaccggcatcatcctcgatgtcatggccaagaacgaccgcaaagcatttatcattgacgccaatcaattcgccatgatgcggcgccagaaatagcacagattccaaatatggctgagagcaaaaagatacttgtcctcagccatattttatcggttaatccgtctgctacttcacccacttttgggcattcgtaccatttgcggcatatagttgcacattggcaccattcgaggtagaagcacccgaaacatcaaggactttgttttccgcgagcgccgactggaacgtgtatgagccatcggagtttttgacagctatccacttttgagcgtatgttccattggaatcgtactgttgcacgttggttccgttggcagatacgccgccattcacatccaacactttgccggagttcacactggtcagggtcacatacccgttggaatcatgcgtcgctttccacttctgcgcattggttccattacctgcccaaatctgcacgtttccataatttgaacgggaagcgccgcttacatccatcttcatagacgtattaagcttcgatccaaacgtgtaggtgccatccggcagatcctgcctatgcttggccgcggtttcattcaaacgttcgcgcaacgttaacggcgcctttgcaaccaaccactgttgagcaacggtgccattcggcgaataaagctgcagctgagcctgctgcacggcattaccacttggaatatcgacagccttattagcattcaccgacactagcgcaaccttgccactaccgtaatttcgcaccgtccactgttgggcaacagtattgttactcgtatattgttgcaatgccgctccattagcagtagatccgccagatacatccagcaccttgcccgaattaacattgacgatcttataagttccattgccaattgattcaaatcgatatttctgggcgttcgtattattacttgaataaagctgaactcgtgccccgttcgccgttgacgcactcgtcacatccgtgacaagttttttattcgcaaccgaagtgataatcatcgatactccagtagctatgttgacatcgcttgacgaaacaacaaacagctgtgaagcagtgccgttgggcgtatacagccgaatcgcagcaccattcgcagtatttccaccgctcaaatccagaacccaattaccgagagcggattgcaaataatatcccgctccagaatcacgaataaaccatcgttgagcttgagaattatttcgagaatactgttgcactatagcgttattctcagcaacaccattacgcacgtccaaagccttgccggaattcacattgacgatctcgtagctcccatcagactgcctagtaaaagtgaactgttgagccttggaactgttaccggaatacaactgaatggcggtggaatctgcagcacttccaccaggaatatcaacactagacgcaactttggaacgaacattgatgtaataattgccattcggaatggtaactgcagtcattttgcgtacatcaatggccgcttgtaaagcattgctgctcccgccattcacaaactccttgttcccgaacgcattcatgtccacattgccgctgatgccgtccaccttgccggagctggtgtattgccatccgcgactgttggtcgggaacgagtcgaatcccatgcgagcgccatactgcgccacccacgtggttttggcgtaaatgtcggcatgtttcagcggtccttgcaggtagctggtgtacgagtaaacgccaagattcttgtatccggcggactgtagtgcgctgtaccaattgttgacgatattgttgtacacgttcgggtcggtgggcggctgatgcccctcccaggtccacttttccaggtcgtagtacacggggtacgccaagtcgctcggattcacaccgaattgcttgagtttggcgaccacgtcggcaccttcttctttggcgagcgccggagtgtccgcgtaggaataccagtagatgccgaacgggatgccaagtctcttgcattcggaaatgttacgttgcgctttcttgtcggcattgttgccttcgccgtagccgaggcggatgatcgcgccttccacgccgtcggctttcgctttggcccaatcgatgtcgccttgccatccggaaacgtcgatcacgcctttggcttgctgcacgaacaggttgttctggtagtcaaagaaagctttcgaattgttgtaggtgccccagtgcgcgccgtattcattgctttcgaatttggagagctgtacgttcgcgtcggctacagcatttttgacatcttccgcacttaccggaatgaaggattcgccgttggttttggcgagcggatccggctgctgatctttcgtgccgaccaatgttggatcggtcacgatttcgccggtttcgatgttcttgacctcaccttcgggggtgacagccaggtcttccgaaaccacggtggcatcgtcggaaatctcgtcactgacgttatccggaagtttcgcattcggattgtcgggcatgctgtcttgcgattgctggtcgcccgtctgatcatccgactgatcgtcagactgcataacaacaccatgatctgcagtaacggaaccgctttgcgcaacagcatcctcaatcgcaatatcctgcaatgcgtaagccggcgcaaccgcaacggaagccgccaacgcaaccgcagacagcgcagtcacgatcttcacaacatgatgtggcgaaaccattcgtcagcctctcttgaatacagtcatcaaccccaaatattcggcgcaaacgccctaatcgtcaactctaactgcaacccacaaccccgtccatccccaactccaaaatcatcccaatccccacatctcacgcattacacactgataagaatcgactagctcgttaggggcaccgatatggcatcatccatttccatatctcctttccagcattctcgctgaccttcccatcacgcttcgtagagggaccatttccaggaggggagtacgtggatcgtgccagtggaatcgggaagttcaatggtttctccctcgttaagcgtgagaatcaggccggaatcaacgttggtacgttgcataaccgcttgcagagagccgatttctcgcgcccttgttttctcatttcccatattggcacacacttgaataagcccatacggttccgtagcaagagcatcgccgataagaaagtcaactttctcctgtttggacgtcggcatagtgtacgaagtgattgtttccgtacgcctaccggaagttcgtctctgcagttcgcagaaaatcgcagtttccagtcgttttccaatatcttgctggttggcgcgtgacaccgcgtaaaccataccctgatcgacggcatacattttcggcaccgcagtactacccggcttgagcatggtggagtattcttcgagctggtagacaaggaatgcctgcctgaacagatcgagtaacgtattcgccttatcccaatagattttccagccgaccgctcgcaacgtttccacaagaccattggtagacagctcgcaggccgtattgcgcagcaaaaacagcgctatctgcgtggcgagagtaatgttttcacgaccaagacgctcggcaacgtcacgcgcaaccacgtcccgcacgtaaccttggagcgtttcaatacgatcagcttcaaccatacgttgcactgcagggaagccgccaatagttaggtaatcgttgtaggcagcttcaaaccgggtgacctctcgcggcgaaaacacggcatcggcaagagtgctgcccgctgtaggcgtttcgattccccgaaagtcgcagaattcacggaaagacagtggcgccatggcatgcggatgcgatcttcctcggaaattcgttgcgatttcttcgctggacagtttcgaagacgatccagtaatgactagcgtcacagcttcatgttcggctatgcgctggcagaatccctgccaattggcgcattcttgcacttcgtcaaggaagaggtagcagccatggtcacgagagtcgggatattgccgccagtattccgtaacaatatcgttgagcacggtgtcttgcattggttgcagacgatcgtcagcgaagttgaaatagaaaatatcattacgcgagacgccgttttgtaacaaatcatgaattttctggaaaagatagaacgttttgccgcaacgtcggatgccagtgatgatgtgcacagcattgaacactgccggctgcggcagctcgcgtatgatttcgatgcggcgtgacggcgtaggaatgtcaaactgcatggactcacgaaccagcatggcatacgattcacatggattatccggcaccataagttcttcctttcgccgtccgttgcgaaacacccaacaatcccagcataacacttctcaaaaattttaagaagtttccaccaacacttctcaaaatttttaagaagttaccacagacgaataaaactccagagagtacctgaatgcattaacgactacaacacgagtgtgggaaatcggggaaggacgggtatcgtacgctgtatattggcatttcaggtggactctcggaacgtgattcaattgacctgaatcgggagctgtcaccggggagtgcagaatagtaggcagattctggaggggttatggcacggcacggcaagaagccaagcgaggacagtacctcgtcacacacaccgagaacacttgccggaagcgcaacgaccaacacttctgccgacagcactgacgccgctgccagcggtatcgctgttaacagctcgaccgtcagcagcgcatttgccagcgatgccgatggcaataccgggaatacgcttgtcggcaacgcttccaacgaagtcgaagcaaccgaagtcgaaaccaacgcaaccagtaccaacgcaaccagtaccaacgcaaccggagagcgcacaatcagcagcagcaacacggctgaaaccagcaaccggcaatcacacgaatccagcgaatcccgccagccgcaagacctattcgacgcggccatagcgcaaggcatcagcgacggcgacgcttggacggaccagcgcgtaaagcacatctaccgccagatcatcatcgccgtagtcgtcgtagtcgttgttctgggcgcggtcttcggattcacaggcgtgcgcgcatcgcagcaaatgcgcgacctggccgcactcaacgactgcaaggaagccgtcacggccatgaacacctcctattccaaggcgttccagctgaaggcgaagatctccgaagcgttcaccagcttcgacgggtcctacgatctcgacaagcttgccgaactgcaccagacggaagttaccgcgccgaaaacgctgagctgcgccgccgacacttccgctaccatcagcaaagccaacgccgcaaaagccgagtacgacaagcaggccaagcagttcaagcaggctttgcagaagagcgacgaatccgcggacaccgatggcggtgacggaacagacaatagcgctgacggaacggccggcgacgacggaacggacggagccacagacacggagggcgatgctggagttgccggcgacgcgggcgccacggacggcaccgtcgaccaatccggcgcagccgacgcgaccgacgcaacgctggacgatcaattcctccagtaaagttgttgacccaacgcaactgattacaacgatttcccaaggaaagaaatcagcatcagcacaagctaaaatttccaaaaatggcgatttcacctgcaccttacctaaacaaaaagcaagccttaaaccatattcattaacgattttatacaacgaaaccactttgttgactctgaaaaacgtgtatgttggcgacgtatttattgctgccggacagtcgaatatggaattgaattattcgcaatattatgagggttcaggcaactcctacaatttcggcggaggtttgataacgaccgacgatctgccgaagcagctttccgacaacaacgtacacttcgttgcgagcgccaattcctcgaaaggtacggattttccgttacgcgacgtgaatgagcaggctggcacctggcttgaggcgaccgccgataattcgcagcatttcagttatctggcgcagcagtttgccatgcagcttcgtgccgcgcatccgaacgtgccgatcggcattattcaaaccgcatggggtggcacgccgattcgacgtcacgtgcaaggcggtgatatttatgcgaaccatattgcacctttggaagggttccacgtggcgggcgtgctgtggtatcagggatgcaatgattccacgaacgaggcgaccgcgctggcgtacgagtcgcagatgacgctgctgatcaaccaatatcgtgaagtgttcgatcaggatgatctgccgttcctgtatgtgcaattggcacgctggcctggctaccagtacacgcaaaacgtgcgattcgcgcagttgaacacgttgagcaatgccggattacgcaatgcttccaacgttgcaatgacggtgtcgcttgatacggacaagggcacttcaacgttgatacatccgcttggcaaagatattctcggcgcgcgcatggcagcgcaatatctggcgatgtcggaaggcaagaccattcccaacgggccgcttatcgcgcatgcgaagcatgcttccgatggcacgatcgtattgtcgttccagaacggcaccgcaaccggtttgcaggcggaaaagcccaattattcgaagactgcgagcgcgaccgtgcccgattatgatgcgaatccggacgcgactcctttgaatggtatttccaacgttgcaacgccgacttccacgccattgcaaggttttgaaattgccgacgattccggaaagtgggtttcggcaacggcaacgattaagggtgatcagattgtgctgagtgccgccgatggaagctcgaattgcaacgcggtaactcaagtgcgttactggtggagtggaaatccggttatttccagtctgctgtataacgatctcggattgcctgcaagtccgtttattgctgttgttgagtaatacggcagattgataatcgggcattatccggctgcgacgactaatcgataaagcggactgtaattaggttagaatcaggcctgtttcatcgaacttaagtcgaaagcaatgtcgacggtcaaaatcgacgatcaatcgacgtagtgcggggcgctggacgctatgcggggcgttatggagccgctattgccgttgccgtcggtactaccgtctgcatcgaaatcttgcgatttacgaagcgagccggcagccagcgaacgtatggatcgaacggaacggccaatctgtgcctgtttttcctgagcatccgactgtattgcgggaatcgtgcccgtcacagggcgaatgcggccggtcgcagtgggaatgaagcttggcggcaacacctgcgtggtaacggcacccggcgatgacacatggtagtgggccatcgaagccagggaatcgcgggtatcgagttcacgctgcatatctagctcatcgtcgaactcagccatcgctgccctccctctcttcaagcaatctctgccggtaatctctccactggcaacggtcatcgttccgagcgtaacgcaaggtagcataccgttacgaacgaaatcagcgatatgcgcaactcccccactgtttcgcaacttttccgttgcatgtgccgcagcgagccacgccagcgagctattgaaaacccgccgttttggcataaaaaaaggcttccgaaatcatccggaagccctactggcggagaatacgagacacaaacttttcagcccgtaagccctactcccgcttgggttttgcaaaattcaccatgacgaaaccctattcaaaacccggttaccggcgtgtcgcggattgccttcagcacgtcagacgtcactggctcgttacatcagccccagcgcggccctgtccaacacgcactcgccgcggtactgcttcaaggacccccgtacgcgggcgagcttctggttccgcttgaccggatccttctctttgatcgccttggacacgatgttgtagtccagcgaatcccgttcggtcttgaacaccgtgagcaccggacggctgccgttcagccttccatcgcccagatccaacgccgtgttggggaacagttcggaactgcggcgcgcataaccgaccgcatagggaagattggcgcagatcgcgtcggtcttggtacggcccggcagcacggggctttcgaccatcatgatggccttggcgtcgatgcgcaccaacgtggacagcacgagcctcttggcggtgacgcccctgttgttcggcagtaatccatccggcgtgagacgcgacctcaacgccatctcccagaaatccttcggagagacgttctcgtagtgcacgccgcacaagtgcatgaagttgccggccctgtacagcgtctccatgggagcggaaccgtcaccaggaacgaaaagcacatgcctgcccaacagacgttccaagtagacgggcgcgcacgcatgtatggccctgatcgagtcctcgggatcgaaacggttctctttcaacggctgtctcccggactcggcacggattcaggaaatagtaatcgacgccggtgcccttgggcttgccggcgtcaataggtcttttctgtcgctcgcggacgacgatcacgattaagggcgcgctcccagccggatgcttatcgtccaccggcttgatggactagacgtgttccgccttgcggcgacgccgttcacgtctggcgtcgaattccgtttaacgtgggaccggcacggactggtgggctggacggctttccaaatcaccaccaatatacacgaacggcaccaaccgccgcaaatcagcttcagggaaatccgggtatgtaaaataagtggttggaaattgatattgacgttatcaatattttgtccatataatatgcgtatggagattgtcggattcgaatgggatgacgtcaaggcggacatcaacgcgcataagcacggtgtcacgtttgaggaggccgagacggtcttcagcgatccgctgtcccgggtcatcgaggaccctgaccattcgtcgtatgacgaagatcggttcatcatcctcggaatgagcgctctgtcgaggctgttggtggtctgtcactgctatcgcacggcgaacaataccatccgcatcatctccgcaagaaaagccacccgccacgagagcgggcaatatgcagggaaaggacgttgacatgcgcgatgaatatgatttcagcgatgcgaaggcgaacccctatgtcgttacggcccgcaggccggtgactatgaacctcgcgggacaggcgatcgactatttcaaagacatgtccaaggagacgggcatcccgtatcagaacctcatcaatctatatctggtgcaatgcgcccgggaacataagaagctcgaattcgtctgagcaagaccatccgtccgtgcgcaccgggcgcgggtctccatccctcgtcagttctggcctgaaacctggtccctggcggacagcggcgtcatgatgagatcccgcgtctccgcctcgctgagctcgccgccatgcaaggcgcagtacgccttgatcgcgccgaacggcttatcggcacccgactcgggcagtcccagcagatattccgacgtggcatgcagggccgcggctatgttcgcgagagtgcccgacgagggctcccgatctcccgcgaggtatttcgagatgttcggttgggtcgtcccggcccgtgcagcgagctgggactggttgataccatgccggcgcatgagcctgcgcatcctgtcgccaagtatcgctgtcatccgaatgtcctttgctttttgggtcatggcgtttctcttggctctgttaaaccagaatcggcataaaaggggtatataaaacaaacggttgggacatagtggcaagtcgtcgatccgaccaaccactagcttgacaattctcaaccacttgttttacatacccggaaatccttgcccggcttcatctcagatgcttgcggcgtttcacgccccgaaaaaggcgtcgatgcttcatcaaaccgacaatactatcgatactatatcgacactttggcgattgcgcgatggtatcgatacagtatcgatagccactggttgaagacgtcgagcgccatgcggatcttcacgaggcacgccgcggagggctctgcaccggaaacgaacggcctttcaccccgtcacccgttgtccctgatgaagtcgtccactctcctgctgagaatgcggtggtaggcgatgaatgcggagaccgcaagaacgatccacaaagtcagccaatggacccgtcccccgaccatccggccaacctccacggacaccacgagggtcccgcttgcgaggaacgtccagaacaccatatgcacgggcagggtgttccatgctcgatgctcccgccaggcatccatcgcggtacgcccggccgaatacacgagaacgcccatcgcggcagccaaggccaacacgagtatgcccgacatcagcagcagcggcctgtaccaccagctttgagacgctcggccgaactccatgagcatcgccgaaacccatcggccaacgctcccgacctgttccgaccgtccgcgaacccattcgggaagactcgcgagaagcgcccgccactgccccgccatgacggcgaacagcatgatcgaggcgaacacgcacgtccccgtgacgaggacgaacaacaagcgccgtccgaacccgagacggtcggcagcctcccgttcgagcctcgcccgctccagcccgcatcgttccgccacccgtcttccgatctcgtcttccatgccgtcgcgttcggcgtccagcctggaacggtcccggcgaagcctggcctcgccgtccgcgagttcagcctcccgccgctcgatgcgtctacaacgctcttcccttgcggcacattccctctcccttcgattggcttcgttcagcttcctgctggtctcgttgagctcggaaagctgcctcctgagcctctgattgcctgatgagagcctcgtcctttcctccccaaccgcttccagccgctgttggagttccctgttccgcgcgatcagcgaatcgaggtcgggcatcgtcccgtcgtcctcgttcgtggattccggcatcgaccgctccaacagcctgcgcgccagaccgccggccatcccgtccgttcggatcccgttttcccgttccatcacctatctccttttccatggccgcccgattgacgtcaatgacgtcaaaaccgctgacatcgatgcccgccaggcgcgctccccggattatggtccaatatcgcgcctcgcatcgctcgagcgtccgttcccgctgccccatttccttccgcgtctcgatggcgagatcgtcgtccccgttgacgatggcttcactcaacgcgatgaccgtcgagcgaagctcgtccctcgccgcatctatccgggccacgagattgcacatgccactgcgcatgtccccgtccgcctcgcgacgtacctggatcgcctcattgagcccgtcagccgcggcccggagctcgtcgaggcttctagcctgcgcctggtagtaacgctgttgggcgggcgtgacgccatgcctgacgaacagacgcctgtccgtcgtcaacggctcgagacgccgctccgggcgtccgaacccgtcggccaaatcgtccgcgccgacacgtcccgcgtatctgttggagcggtcgagaagcgtgacatgatggtcggccggcaggaacagatgccacgtattgccgttcctggcgagcatttccgtggggatgacggccttgcgggtgcgctgtgtgccgggcatccacacgcacaccgcccgctctccgacgctggagacgagacgctggttgaacgtgaggtggatggtctttccgcctccgatgcgggccgtcaccgaatcaaggtcgtaagccgggccaagcctggtgtcacggactttcaggcccgtgtccaggtccgtgtaggtaagatgccggccacgcaaggccaccccgacatgcgcggcggcaatattggactcgaactccccgtaactgccggacatggccgccgcgagctcgatggcggcacgaagccgctccttcgcgcccttgcccttggcgatggcatagaattcctccatcgatgcgccacgaccgttcatggggaccacttttgatgatgcggacggcactgccgtgctctcctgccccggcgtccgttccatgatccgccgcatgtcgattctcccggcttccgcatcgaccgaaggattgtcgagcgtggccagtccctcgcggcggcacaattcgtcgctgaccgcacgccattggtcgatgcttccgcgggtcagacgcatcttcctgcgggtgcgtcggttggccgtgcagatgacgatgtggttgtgcagatggttcctgtccagatgcgtggagacgacgtaccggtattcaccgcccgtgatcgcctcggccaacgcgatgcccatctcgtgcacccgctccggggtcacgttctcgtccggagcgaacgaatgcttcagatgcagcgccagcacgcttccctcgcgcatgccgttcgcgcatgattccaggtcgaggatcatgggtccggcgagctttccggcgtcctgccgctcaccgctatagctcgcgtacacgaaccggcctccatccgtcttggcgggattgatcacatacgcgagcgtgcccggaaggttcgtcttgaccttccgcccgagtttcacaatggccatcacgcacgctccccgccgcgggcttccatctcttccttggcacgctccatgccttccatgagctccgtgatgcggtcgagctggcggcgcagttcatccagctgcgcgggcgtgacggcaccgctcatgttcgccacacgggccatctggttgacgttcgttccgatctggtgcagctccgacttgaacacctccggatcgctggccagcaccacccggggcatctcgaccaccgggtacagaagcctctctcgcgcgtactcgccccatctgcggtatgcgatggccgcgcgcaacgactccttcatgagcgcctggcgaagccgctcggcacgctcccactcctccggagcgaacatgacttttttgcagatcggtctcctgcgtccttccgtccagctcatcccgtcacctccgaaaagccgagggacgttcgctgatcgatgccgcgcgagcggtctggaggccttgccgaccataggggccgggattccccggcaagccgaaccgttccacgggctgagcgagtgtgtccacactcgcgtcgcttgctatccccgattccggtatgccggatcgggatggtttccgaccgttttcccgcaaggaaacggccgcgttctcgtcgttcattttcggttttccttcctgtctttcgcaccgggaacacggcgcgttcacgaccatgttcccacaggaaaaccgatgcgggattggacaaaaaccgatgcggaaactacgtggcccggcccctgttccattcaggaagcgggaacggaaaggcccgtcgtccgaaggattttcttccacggaaacgtgtcggaaaacacgcgcgcgcggatggcgtgggatgattaatccatgagtgttcttgaacgtcgtacgagggtgttggagttcgtcgagcggtggaagggccgtggcaacgagaagcaggagacgcagcgtttttggatcgatctgctgcagaacgtgctcgatgtcgagcgtccgaccgaggccgcgttgttcgaatacaggaccgtgggcggcgggttcatcgacgtgctgtgtcccgaggcgcggctgctggtcgagcagaaaagcgccggcatcgacatggacaagcccgaggccaggcagggcactcccgtcacgcccgtgcagcaggctttacgctacgcggacgccttgccgttgagcaagaagcccgcggtgttgtgcacgtgcaacttcgaaaccttccgcttctacgacctggaacaggatccacgcgccacaggaacacccgtggacgagttcgcgttggaggacctcggcgaacacctgggcaccctggaatcgatcttcagcagcgagcattcccgcgtcatggtcgagcagaagctgtccgagcacgcgggcctgctcgtcgcgaacctgcacaacacgctcgccgcgcaatacgacgatcccgacgacccggaaagccaccacagcctcgccgtgttgaccgtgcgcctcgtgttctgcctgtacgccgaggacgccggactctaccccggcaactcgttcagccaatacgtcgaaagctacgacgccgcgcacctgcgccgcgccatcatcgacctgttcaacgtcctgaacaccccgttcgaccagcgcgacaagtatttggaggacgacctcaaacgcttcccgtacgtcaacggcggcctgttcgccgaaggcatcgagattccacagttcaccgacctgatacgcgaatccctgctcgcggccggcaacgggttcgactggcgcaccatcagccccgtcatcttcggctcgctgatggaggagaccctcagccacgaccagcgccgcaagggaggcatgcactacacctccgtcaggaacatccacaaggtcatcgacccgctcttcctcgacaatctcacggccgagctcgaccgtgtcgaacacgaccagacgcttggcgagagggcccgcgagaaccggctcaaagcgttccaggacaggctcgcctcgctgaacttcctcgatccggcgtgcggttcgggcaacttcctgaccgaaacgtatctgcggctgcgcgaattggagaaccgcgtcatctccgacctgctgcacggccagggctacatggaattgggcggcgagaacagcctggtcaaggtgcggatcgaccagatgcatggcatcgagatcaacgatttcgcggtgtccgtggcgcgtaccgcgttgtggatcgcggaacagcaggcgttggacgacacggaggccatcgcgggacaggcgttgccgcatctgccgttgcatgattcgggcaacatcgtgcaggccaacgccctgcgatacgactggaacgagctgctgcctgccgccgaatgctcctatgtgatgggcaacccgccattcatcggccatatctcaaagacggctgaacagaccgaagacctcaagcatgtgttcggcaaagcgtatgacggctatcttgattacgtaactggatggtttaagaagtccggtgattatctgcaaaatagtaatgaagcagagtttgcgttcgtatcaacgaacagcatcactcaaggtcagccggtgcgtcaactgtttgaattgctattcaagcagggatggcatattggctttgcacaccgtactttcaaatgggattcacaatcaactgacaatgcgaacgtacacgtggtagtaattggcctcagcaagaaggaaacacggcctgttctcttttcctatcaagacatcgtcgaagagccaacgattacgtatcctgctcatataaacggctatcttcttgatgcgccggatgtgtacgtggctaagcggagtcagaaacttgggccaatttccccagaactctctcgggtcaactttggcaatctttcgcttgatgatgggcatttaatgctgaatagcaggaaggaatatgacgaggcgatggccgatccaattgcctctcggtatgttcgtagatatgtaaatggtcgagaactgataaacggtcttgatcgttggtgtctatggttccctgaggctgagcctgctgacctaagagcatctgtttttattcgtaagcgggtggagcaagtcagacaatttcggctctctagtaagaggggggcgacagtcgaagcagcttctacatcttggttattcggagagatacaccagccaagagcacagtattttgccatgccagttgtatttagcagtagaagagactatgcctcggcgagcctacttccggctgaggtaattgcaggtcagaaactgcacacctgcatagatgagagcggcatcaacttcgccattgctgaatcgtcaatgttcatcacttggcagaaggcaattggtggtcgtttgaaaagcgactgccagttcagtaacaccgtggtgtggaacaatctgccattgcccgcattggacaatgccatgcggcagaaggtcatcgatgcaggcaaggccgttctggacgcccgcaaggcgcatccgggccagtccctggcggacctgtacgatccggacttcatgccgcagaacctgcgcaaggcccacgaatcgctcgacaaggtggtggacgtggccttcggcgctgccaagccctgcaagagcaacgacgaacgcctccagatccttttcgaccgctacgcggaaatgacccaggagcagtagccatgcagaacattcttcagatcgaaaaccccagctctgatgaagagctcagcaaggcagccattcataaggcagaaatgagtcttgtagagctcgaagcaaggttcaaggctgtccgcaaactcgggcttgaaaatctggcggccgaagacggaagcattattgccaacgccaacaaacgttccatgggcatataccaaagtcagctcatttccttgctgcaagtttcattggaaactcttaatgcgatatttgcaacgcaaaatgaggcattggggattaccccatatatcctgaaccgttctgcgttggaaagcatcgccacggcaatatggcttgcttcattcgacactttggaaaagagagcctttaatgccctcagattgactctcgataactacaaggactccaaaagggcactgcaagaaattgcgggtgaagcaggcgaggtccaggcgctacatgacctcgccacggcattgctgggtgacgccaaacgtcggttcaaggcatttgaaggcaagcaagcatcggggatgcctcagcatactcagatagtcaagaaggctgatgctatctatcgtagggtcagaggcaaacgccatctttatcaaggactgacttcttggcagatatgcagcggcgttgctcatggtggccagatcgccattggcaatatgcccgtcttcacggtacttaaggatgatgggaaaagatatccgaaagcatcaacgctgtctcttatgctgtatccaacaatagaaaatcttgaattgttcaccgagatataccaaaagcaatgcgaatgcagcaaggtgaagacgcaggataacgggtagaccggcttttgatggttcatgaccgccttcaaggaattaaattttatgcaggcacacagttaccagacgttcgtatccatgttttacgctctcgatgcggcgtttgaggagaatgacacggagcgtttgcggacgttcccgtccgaggcgaatccgttcctttaggaagacaagggatcggccaatcctgcggtgtacgaggagttctcgaaagcctttgacgaacgtttcgggactcagggggctgttcccgaggatacgatggcattcgtccgggactatctcgacgcccggaacggcgaatactgttgggtggaaggcgatctcgttgccgctttcgacggcattgtgaccccgcagctttgggagcaatcgctggaagagacggcggactgacaacatgcccgctaccgacacccgtctgcgtcgaacaacgtccgattgattattggcagccgtgcttcgagcaatcgcgcacggcggaaaccatgaatcgttttccattcgtcgtttccgccataccttttacgtcgattcagtagctttccacgatctcgtggatcgccatgtccatcgcgccgtgctgcgcctggatcatgccgtagtagcggtccgtctcggtgatctccgggtgcgcggccatcacgtccgtacggcgtttgaggtgcctctgctccatgagcatgtccatgttcctgccgtactggtggcgtgtgcgtcgttccgtttcccgcagatgctgttcgagcacgttggccatcatcatctcccggtattcctgcggacggttggcgatcagccagcggatgcgcatgttctggatgccgtgcatgctgttctccgtgaacaccttgtacggcagggcccatgggctcgcgagtttcggatgcctcctgtggcgttcctccatggcctccaggttcctcctgtaccgcgcttcgaggtccttgtccttccagaccatttccttcgcgtttttcatcgtttccgtcctttcctggtgtcgtggtttcccgctgcggatcctgttggtaaacgtttaccacgctgtttcgcgggagcgttccagcgtgtcggagcgaatgaaagcgacggacttctcaaatcacattgtcacgcaccagtgcatcagcagcactaacaaagcatggacggcatagaaccaacctttcattcaccctatatcgttttcagccccgtcttttggaaatgccatattcaaatctcatcttctatatggcaacctacacggcctaccgccctcaccctactctctattaggttttcccgacccacacaatcgacctaccgacctacgttgcgatccggcggtaggttggtaggtcgattgtgcaggtcgatgaatcccatatatttcaatatgtaggccggtaggcctgtaggctgtccgttaaaaatgtcagatcagcttataccattcccctccagcaccctttgaggacgctctgacacgtcccgaacgcatcaggttctccagtgccggagatagcacctcacgctgtcgtttcgagatgctgttgtgcagggatctcctggatagctcatggcttggagcgttctcaagcagggacatgatccgatcctccaccttcttcgcgcgctgcgtctcggcgacgtcggaagcgtcgtccgtcagcttcatgcgttccgccatccgttcgctgcgcatgatatcggactgcttccgggcatcctcgaacgtcttcgccgaatcatcggcgagaacgccggcaagctcccagtcctcctcgctcacgaccagtggatcgccgccgctcccgagacggagcagatgcatggccgcggccagtttcatgcgcatgtatgtgctgtgcgcggtcggcgaggcaggactgtccatgctattggtgcggatccggtcgaagatcacatgctcctccacgattttggggaacgtcatcggcttgagttcgtaccgagcgccttccattccttcgagggccagcttcccgtaccctccctccgaatacacctttcccatgatctcggcgggcagatcggccggcaggattccctggtcgtacggaaacatggtggtgtccggctccggggtggtgtcgcggaaatccacgcgaaggttggcgatgcggtcgctcagcgcggacacgtagaggaaccgctgctgcaggccgacgccgtatccgttggtgaacacgtcgatgctggacggctgggcggagatgacggggatcccgcggtatccgtggtcgggtatgacgaccgacaggctgcggtccttggtggtctcgccgatccgatgcccggagaacacgtccagcagcgtggacctcagggtgctctccttccgtcccatgagcgcctggagcgtcgatatctccgtatatcgcaggatcgcgcgcccgttcacgaactcggtacgatacccgtcgccgtccgatccggattcggatcggacnnnnnnnnnnggcgaagatcgcggacaccgcctgaccggtcgcgggagcgccctcgtatgcgcccctgacgtcgggaacgaggtgttccgccgtggtgtacgcggtgtccttgcctgatgacgggccaccgagcagcaccacgccgaagttcagcgaaccgtagctcgcgccgaccaacgccgggagcacgatgtgcggcggtgtggccgcgacgatcctcgccagcacgcatgccagcaccgcatacggcgataccatgtgccagaccgcgaagtcgcgaatctcgcgtagttccgtgcaggattcccaatagcagtcgtcgtcgaaggtgtatcctccggcgagcgggttgtacggatgcccaccggcggtgcggggaatgccgccgcccacgaactcgcccctcatcggatttaggtctatcattactagtgcagttcctttcgaggaatctggcggccgctccaatggcaatgtgtggagcggccgcttttttattgatattggggttgctatctgccgacgaattccttgagggattcgtacgagacgagatagatgcgtcccgccttgcacgcatggaggtctccgctgcgaatgaggtttcgcacgcttttgggatccttgaatcccagcagtcgtgtcgcctccatgatcgagacggacaacggttcaagattcatcgtctggttcttgggcatgttctatcgctccttgtctagtcgttcgtgacgttcccttggggattgtcttttgctttttcgcgccttcacgacgcttataacgacactaaggcactttcgggcgtgtcgggattggacattttttctccgaatctttcgattccccacttttcatgattcgcttagcagtttggcaatggtttcgatctgggcttcctcggagaaatgcgacagtatcaggaatcgcctgccctcttccatcgatcggagcacgttcgcccgcactttcggatccatctgttcgagattcctcgacagcgactcgatctcatcgcgggatggcgtattcatgccgtctccatcgttggtggccgccgcgcgtttcatgcgggccgcgttggcatcggcctcgattccggcgaggatcttgcgtttctctttttccgtgacgtgctggtagtgcatggcggtgcttacctgggtgtggccgcccatctccatgaccgccttgaggctgttcgtgtagctcgccacctccgtgagcgcccggtggcgcagatcatatagcctgaccttcttctcttcgagacgtggaatcgtcttgcgggccctgtaccaggcgttcctcacgctttgcgggttgacgatatcgtgcgtgaccgaaccggtgaacatcggcgactcgggtaacggtccgacgaacttccccagatgccgctcgaagcaaggcaccaggtatttcggaatggcgacgtctctgacgctgcccggggtcttggtcttgccgtatccgcgaaccgttcggccgtctttctttatgcttatggcggctctcctgacacgcaccattccgccttgcctgtccggattgatgtcgatgtccccacgttgcagtccgtacgcctcctctggcctcagacagagcaccccaaccagatagatgacgagggcgtgccgctccggcatggctgcgtacagcatgtccagctcctcatggctgacgtcggcgtcggcaatgtcggccagtggcttctcgacccggatgttgatggccggattgctgccgatcaacggctctcctgcgcctttcaccttcttcgtgctcgcctccgcgaacatggcgcgcatgagcgtggcgacatgccatctgatgctggctccggcgccatcgcccgacacgtccatcgaatcgatcgtctcgcgcagcagggattcggtgatctcgtccatgcggtacacgcccagagccggaatcaggtggtcccgcaggtactggcggtatttttccacggtctgttcggccaagggttcgccgttggccttgcggtgctcgcgcaggtagcccatggcgtattgcgcgaaggtggtgccgtgcgcctcctccttcagctgctcgagctgcggcggcacccatgtgccccgtatgatgtcgcgttccgcgtcgttaagccaggtttccgcatcgatcgcgaaccgcagcgggaagttcttgtagatccgtttcttgccacgcagctggtcgggccacttgcggtacgcccataccggaggctcatacgatgcctcaaggtatcgggggttcttcttgtttggttttttctggaggtagccgaagcgtcgtctgcccatgttggtctctttcggaaaagtgcgtctggacgccaatcgggtaggaatcgaatcttgttggatttatgcccgaaaggttacccgatatcctatggcgcccagcgacacttcagattggacaaaggctttggatacaaaacggcaaaaagaacgcaaagcgttggaaagacgccgttttcggcatgaaaaaagggttttcgaaatcatccgaaaaccctacccgcggagaatacgagattcgaactcgtgaggctgttacaccaacacgctttccaagcgtgcgccatagaccactaggcgaattctccaattatgcaacgtctcacagtgtctatccgcgaaacgcaacttgattagaatacaacagtttctttcaaaccccaaatcggcgtgtcgcaacgtcccagatcgcccactcactggaggaatccgtacacgtgaggactttcccgcgcaccgaattctccaccctctgggacaattcacccgccaacgcacctctcagcatcccagatcgcccactcactggaggaatcagcccgctgccaagactctcacagtccgaattcctccagtggctggaacaatcagtacgcccataggccttctacagtccgaaaacctccacccactggaggaaaacacccgcgcaccggcctccaaacgtcctgaaacctccatccactggaggaattgatacgttggtatgcttcccagcatccggattctcccacccactggaggaatctgcccgcacatacacccccgaattgtccagattcttccagcgagtggagggatccggacacgagctcacgtaccgtgagcacagcagctatcgtttggacgcgaaggcacgcaggttggcgagcatggcgcacgccatcaccactgcaaggaacacaaacccccagtgcgcgcccgattgggtggcagtcacgaattcgacatctccggccgaaccgtgtccagcctgcgcaacgcccaggaacacggccatgaccgtggtcgcaaccgcgccggaaagctgctggaacgtgttgaacaacgcattgccgtctgctttcagttcaggcggcagcacggccataccgcatgtcatcgtattggcgaagcacatggaaaaaccgagcatatacacgaaataccacaagtcgaacatgaccatcgacgatcctgtgccaataaacgcggccatcaacacggttcccagcaagccgacgatcatggcagtgaacatcgggcggaccggaccgaacttatcaagcagcgatcccgaaaccggagcactagccgctcccagcaacgcgccaggcagcaacaccacgcctgcagcaagcacagacgcgccgaatcccagttgcgaagcgttcggaatcatatagccgtaaccgatcgtcacaaactgcagcagcacatacgcaagcaaatgccaacggaatttcacgctccgcaacacggtcagacgaaccagcggcgagaacgcacgatgcgacacccaagcgaacactagcaaagcggccatggcaatcagcagcagaaccactgcaatcacacattgcgtagtcgcggaagtatccccatcactcactgcggtaacggcggatccgccacggtcgagcgcaaacacgaaacagacgaatccgactgctaggcaaagcacatgcagcggattgatatgcgcctcttcggtaggagtgacctgatgaatcgttttaaggccgcacaccagcgaaacaaacaggaacggcagcagaatcacgaaaatccaacgccacggcatgaacgtgccgacaagaccgcccacagtcggtccgagtgccggcgccacggccaccaccatgcctccaacgcccatcagcatgccgattttgcttttcggagactgttcaagaatgatattgaacatcagcggaagcgcgattcccgtgcccgctccctgtagtattcgcgcggtcatcagcataggaaagttcaacgtgcaagctgccatcaggcagccggtgatgcagagcacgattgcggtaaggaagatggtacgcaacttcagtttgcgcttgaaatagcttgagagcggcgtgacaagcgctaccgtaagcagatagccggtcgtcagccattgaacagtggacgtgtcgacgtggaattccgccattaatccagggaaaagcacgttggtgagggtttccgtaaggatgccaatgaaggccatgattccagttgacagaatggcaagaataagattgatggagatgttctcgtcatcttgcgttgccgtgttattgtttcgcgcaatggactgtgacatggatttgcggccgttcccggccttccctttcttggcccggctttgctgagccaccattccgttatgccgggcagtttgccggaatggcgattatttgcccagaaatacaaaaagatccttgggagcggagcgctctaccaaggatcttcatattattaagttgaatgttgtggattgggagcctcccgcgcgccgcgggaaacacgaaccaaaagacaaaaaaagggggttcccggagcgtcacgctcgacgggaaccccgacgttgaatgcggcggcgtgctactctcccacaccctctcgagtgcagtaccatcgccgcgaccaggccttagcttccg

SEQ ID NO: 79 - DNA, 106365 bp, Bifidobacterium pseudocatenulatum
cgtccttttcatggacgtgcgccaacgcgcgtttttacatcagcttctgcgatcaggcctcgcggctcgcagaagccgcagcgaacgccggcaaggcgcgaggtgcgttgaaaccttccttttcgaagcggtcagcaatcttctgtgcgatctcgtggccctggcccttgtccaccagtgcgatgatggagccgccgaaaccgccgccggtcatacgtgcgccgtacgcgccgttgacacgagccacatccacggcaatatccaactcgggcacagtcacttcataatccgctgcgagcgaatcatgagacgcgttgaacagtcggcctgcctcgtcgatcttgccgttggcgaaggcacgcacgaaggaattgacacgggcgatttcggtgatgacgtggcgcacacgcttcttcatcgtgtcgtcttccagcttgtcgagcgtttccttgagtgcctggaacggatcctcggatttagcaatttcgtcggcgaccacacgcaggttggacacgccaaggatttcggcggccttctcgcaagtggcgcgacgctgggcatactggccatcgttaagctggtgcggagcctgagtgtcaagcaccagcagttccagaccatacttgtcgagatcgaattcctgctgggagacgttctccagcgggctcagctctggacggcaatcaagacgcaacgcatggccgaaagtgcagcgcatggatgcgttctgatcgagcccaccggtggacgcgcccgccatgtcattttcagacttgatggcggcattgatcagcgtcacacgaccggcatcggatgcgccataacccaaaccgtacacgtcatccaacgccaaggcggtggagcaggtcatggctgcggaggagctcagaccggatccgagcggcacgcaggaggagaatgccgcgtcgaagccctgcaccgcatcgaagccggcttcgcgcaatgcccaggcaacgcctaccgggtaggcggcccagccttccacgccaccggcctgcaggccgtcgaggtcggcttcggtaacgttttcggagtcaacgtcggaaaccacgcgcaccttggtgtcttcacgcggcttgagcgcgatgaacgtgcggtgcggcagtgcgatcggcaggcacaggcccgcgttatagtcggtgtgttcgccgatcaggttcacacggcccggtgcggcccatacgccagccggctcctcaccgtaggtggcacggaacagatcggtcgcgttcttcacaccctcgtcgtgcgagagcggctcaatgaattcaacagcagtcattggtgttttgtcctttgggttttattggctttcagccttcgatatcgattggtccgagctcgtggaagcgcttggcgatgagttccggcgtggtgtcggaaacccatgcggccatgccggattcggatccggccagatacttaatcttgttggctgcgcggcggaacgagaagaactgcaggttcaggcggtagttttcacggcgtgcgtcgtggatcggagcctggtgccatgctgcgatgtacggcaggtccatgcccttgccgtcgcccttgtcgaagaacgcgttaccgcgcttgagcagggtggagtacataacggccagatcccaacgttcctggtcgttgagctcgtcgagggtgagcacgtcgcgcaccggagccacatgcacctcgaggggccagcgggctgcggctggcacgtaggccacccagctgtggttgcgcatgacgatgcgctccccggcttcgatttcggagttcatgagatccttgagcaggttgccgccggtcttctcatggtaggcctcggtctgcttgagttcggcttccatcttcggcgcgatgaacgggtagcagtagacctgtccgtgagggtgtgccagggagacgccgatttcctgtccgtggttttcgaacgggaagatctgttcgatgccttccatcttggagatttcggcggttcggaacgcccatgcttccacgacggtgcgcagacgggagaccggcaggtctgccggcagaccgtcttcgtccgggtcgaagcagatcacttcacagcggcctgcagcgagcttcttctcccacagcgggttgccgttgacgtattccacggcttcggaacggcccggcacgcgaaccatcgacgggaagcggttttcgaacacgaccacgttgtagtcggtgtccggcacttcgccgtcctggtacgggtcgcccggcttgcgtgcggccagcgggttgcccttggcggtggcacccggtcctgcggtgatcgggcggttcatgcgtgcggtcgccataggaatccagtcgccggtcagtagatcgcgacgcatttccggagcagcgtacggcacttcctcaccggccgcgttaagctggttggagaaacggtatgccagctgacgaggatcgttcagttcgcgcgtcttcgcgccggaaacgtattccggatcatcgtcgaggtagaagaaagcgcggccatcggcgagcgtggtcggcgtgatgcgaatgtgctccttcgcgtactctccgggagtgtagtttgcgaattcactcattatggttattcaccttcctgaataggctcgctctggtgtgccagcacgagctctttaaccaaatcccttgttttcccaaccgaatcggggtctagtccatcatcggtaatgaccgtgtccacctggtcgaagcgtgcgaaaagcgacaatgatgtgcagctccacttggtgtgatcggtcaaaattatggtgcgatcggcaatgtccatcattgccatatcggttgcggcctcaagcgagttcggcatgaggaagccgcgcggaatggacacggaatgcgtgcccaggaagactgtgttgacgcgcagggaggccaccactttgtctgcgatcgggcctacgagcgagttggatcgggtggtcacgccgccggtcacgatgacttccacgtctttcgattccagcgcctgcaccagttccgccaccggaatggagttggtgaggatggtgatccccgacgactgctgtgattccaacagatgttgcgcgaatacgtatgcggtggtgccgccgccgatggcgatcacgtcgccgggtgccacatatttgatggcttcctgtgcgatggcgtccttcaatccgatgtccatctgcgactttacggagaacagcggctcactcagcagcgtgctggtggtgacggcgccgccgtgcacacgcttcagcagacccttgtcggccagatcggcgatatcgcgtcggatggtcatggcggaaacgcccaattccttggacaatgcggtgatacgcaccgcaccgcgggtacgcaacctgctcaaaatcaaatgctgacgttgtgacgatatcattcgaacattatcgcacatgttcactcaaaataaaaactgagatgagcgtttcgcgcgttttcctcacgaaaaaatatacttggcactcctgtaatcgttcaaatcgaacaaaaacgaacgtcgacatcccgtcagcgaaatcaatcgacgtgttgctttcctgcgacaaacggtgcgagaatagtgaaccatgacgtatgtttctgagaatttctggcacgatgcggtgaacaaagccaccacagatctcttcaccttcggctacaagcacatcatcaagccgcatttcgtgttcaatcagacgcccgatgtggcgcacgaccagatgattcagttctgcaagatcaccaagaacattccgccgctgatgtgggcgtgccgtgaaatgctcaactattccgaccccgtgctggaaaccagcgtgatgggcgtcgacttcgtcaatccgttcggcctttccgccggcctcgacaagaactgcgagatgccggtgctgctcgacaacgccggcttcggcttcgaaacggtcggatccaccacgtctcgtccgtgccccggcaatccgaagccgtggttccaccgtctgcccgaatatgattcgatgatggtgcatgtcggtcttgccaatgagggttcggaaatcgttgttccgcgcgcggaacaggcttggacgaaggcgcgcgacatgcagatttccgtgtcgatcgcgcgtacgaatgacgataagaccggcgatttggacgaaggcatcgaggattactgcatttcgatgcgccgcacggccggtcgcaccgccatggtcgaagtgaacatctcctgcccgaacacgatggccggcgaaccgttcaatcagagccctgaagcgctcgacaagctgttcaccgaactcgacaagatcgaacgtccacagcccacgctggtgaagatgccgttgaataagtcctgggaagagttcaaggatctgcttgacgtgcttgccgaacacaatgtgcagggcttgtcgattgcgaatctgcagaaggaccgcgccggcatggagattcctcgcgattgggagggcggactgtcaggttcgccatgctatgaggccagcaacgaacgcatcaagcaggtgtaccgcgagtatggcgaccgttttgcgattgccggcatcggcggcgtgttcactccgcagcaggcgtatgcgaagattcgttccggctcgtcgttggtcatgttcatcagctcgctgatgtatcgcggaccgcagcagatcaccgtgttgaagcgcggccttgccgaactgctcaagcgcgacggattcgaccatgtgagccaggctgtcggcatcgacgcctgataccgattatttcaatcggcagcgagcaccaaataataatgcgccctgcgaccgccaacgcggtgcagggcgcattattgttgttcgattgttgttcgatattaccttggttattggttgcgtttagtatgcgccacgcacatactgcggctggtagggcgcatcttcggtcggaataccgagcttgtgggcggcgcgaagaggccaattcggatcacgaagcgccgcacgtccgatttcgatggcgtcggcggcaccggatttcaaaatcttcttggcctgcttcggcttggtgatcaatccgacggccgtggttggaatttcggcacgcgagcgcacctgttcggcgaatggaacctgataatcgggtttgacgggaatggtcacgcccggaatcatgcctccggtggagacgtccatcagatcgacaccgtgcttcttcaggactttggcaaggtcgacggtctgatcgagatcccagcctccggcggcccaatcggtcgcggaaacgcgcaccagcaccggcatggtgtcggggatgacggaacgcacggcgtccacgacttcgaccagtatgcggatacggttgtcgaacgatccgccgtattcatcctcgcgctcgttgatcagcggatcgaggaattgcgacagcagatagccgtgggccgcatgaatttccaccgcgtcgaagccgatatcataagcacgccaagcggcgtcgcggaactggtcgacgatggcatggatttcgtcaacggtgagttcgcgaggcttgtccaacggcccgaacgcgttgacgcttggccccacggtctgccatccgccctgctcttccggcacgctctcatgctcgtatccgatggagaagcagccggtggaagccttgcgtccggcatggttgagctgcaccgccatcgtcgcgccggcggccttcgcatcggcaacgatccaacgccatgcgtccatctgctcgtcggcccacaatcccaagtcgcacggcgaaatacgaccctccggcgtcactgcggtggcttccacgataaccatgccgaaaccgcccatggcacgtgacacataatgctggtagtggaatggcgtgggcaggccatcctgggccaacgcggaatacgtatccattggcggcagccagatgcggttgcgcacggtcatgccacgcaaagtcataggatcgaacaggccaaccgtgccattggttgtagccttcttcgaccgcttcgccttcttttcgtcttcgctcatcgtagtagctcccctccggtcgcacctactggctccttgccgatcggctgaaccttcttcttgtattccccttgagcttctctggagatttcgtgccataaaaccggcactatctgcattctacgcagaacgcccgccgagcgtggcgggcgttcattgattgttcacttccattcgctgaattgcggaagcgtcactcatcttcggtctgctgctgatcctgatcatcctgctggtcgttctgctggctttgctgctgaagcgactggttctgctgctgaatgattgtgctttgctgctgggtggcattctgctttccaccgccgatcttggtgaccgtgctggatgttgcggaatacttggccgcaggctgcccataatcgttgtcaatcggcagctgtttgcgttccgcataagcattcataaagtcacgccatgccggggccgcgatggtggaaccatcccagtagctgtggtactggccgttgatagcgatattcgcaatcgggtggccaaccgggttctgcacgtcaccgacgagcacgaatgtggcgatctggttcggaatgaaaccacctgtcgtaactagctgatcctcgtgggtaccggtcttggcgaaggtcttacgtccattggctagctgtgccacaccgcctgcgccgtcaggacggacaacgccttgattcatggcccaagcaagcgtttggatgatttccggatcgaccgcctgatggcagttcgcggaaggcaccttaatatcattgccgtccacatcagtcacctgcttcagcgcgatcggatcgcactgcacgccattggacgcatatacagcgaagatgcttgccatcgtcagcggggacacgttgacgttgccgaccatcatggcaggcacgaatgatgaggtcttgtcgagcgtctcaccggtattcgcatcatgatagccaagttcagttgcggtatcggcaatcttgcacaagccgatgatggatcccatggaagcctgcgtggtgttatgagaccttgccaaagccaatgccggcgtttccgggttcaccgttccattggttattgcgttggtgacgttccacgtatcagtgccgccggtataacgatcgcatgcgaacaacgaggtcgaatacctcgtggacgtctgcaggttctcgttgacggaatgtcccgcttccatccatgccaccagattgacaggcttccacgacgagccgatggagaagcccatgccgccgccgtcttctcgatccacggcatagttcatggaatccctggtctggtcgttctgcgccgcttcggtggcatcatacgttcgattcagaccgaagcccagcacttctccggtacccggtttgacggacgccatcacgatttccatgccggaggaatcttccggtgggatggtgttgcgcgcggtttcgttcaacaaggtgttggcatcgatatccaacgtggtgacgatcttcagaccgccctctttcagcagtctttccctgtcctcgctggtcttgccgaattccttggaattcaaaatcttatgcaccacgtaatcgcagaaatagcccgcatcatagtccgcggccatgcaaccggtggaaataggctggacatcaagcgtatctgcgagcggagtattgaccgcctcttgatattccgcatccgaaatatagccctgctcgttcatcagctgcagcacgatattgcgttgcttctcggattccggctggttcgattcgacggaaggatcgtaagcgttcggattcttggtgattgccgcgatggtggcggactgcacgatgttcagctgatctgcggtggtgttgaaataccgcttcgcagccgcctgcacgccatagaggctattgccgccaaactgtgcgatattgagatatccctgcaaaatttcaggcttggaatactgcttttccatttgcacggaaatcagcatttccctcatttttcgtgcgatggtatcttccgacgcatggtattgtgcgatcggatcgtcatcctgctgcgcctgcaggatcagcacgtttttgacatactgctgggtaagggaggaaccgccctgatggtcgcccttcatgtatgtttggacgaacgcgcggaacacaccctgcacatcaacgccgccgtgagtgaagaatcgtctgtcttcacgcgctaccacggcctgctgcatgtatttggaaatcttcttcaacggcacgacttcacgattctgatcccagaattcggtgattttcgtggtgccatcggaagcgtacatggtcgacttctgcggcaggctggtcacatcaaaatcaataccttcgaccgacagcgacggaataaccgccttggcgacgctgttcgcgccgaaaaccgccggtaggaggaacaaactggcggccacgccgccacccacactcagcgtgatgtaggcaatcacgagtgcgagcacacgttgaacggtcaaagtcttcttttcgggcatggtgcccattctaaagtggtgggtctactaatcaaccggccgatcgcagctatcacgggtttctcacaaacaaccgtaaaacttgaaaaacactggaaaacagtcgaaaattatcgtctcgatcgtcgaataagcatgccaggctggtagatgatgatggaacggccctcacgcgcaatccatccacggttggcgaaatccatcagcgccttgttcaccgtctcgcgcgacgaaccgaccagctgcgccatttcctcctgcgtcagatcgtgcggcaccttcaaccccgcctcgaccggctcgccgaagcgtgacgccagattcagcagcgttttcgccaaacgtcccggcacgtccatgaacacaagctccgaaatgcgctcgttgttgtcacgcatgcgatgcgcgagcacctgaagcatgtcgacggccacgcgcggatgctcgtcaagccatgcgaacagggcgtcatgctcaagccatacgactttcgtgtcactggtcatggccacggcggacgcggtgcgcggtccaccatgcggatcgaacaccggaatctcacccagcacttcgccgtacgcatgaatgctcaacaactgcacacgtctgtcggacgattgccggatcagtttgacgcgcccgcgttccagcagatacatgcggtgatcggtgtcgccttcgcggaaaatatagtcgcccttgctgtattcggcatgctgcagatgcggcagcagttcctccgcctcttcggaagaaacctgcttgaacaacgcggtgtgcagcaacgtcgcgctttcgccactgggtccactattggtctcgtttggcgtagccatttgtcacacctccgttcataggcacatcctctgggcacgccgccaggcgtgttgccgggcgcgctgccgcggcttcgaaagcttgttgcgattccacatgccctcacggaacaccaagctttcgtaacgttctcattgcccttgatatcaggggcggcttcgaccatcgggctacattgtaactcgcctggcggcgtcgagcagccgttcaaccacgtcttcacgactcatgcccgtctgcgagcgcattggatcgactcgttttaccgctgatttcaccgctttgtccgacattttctcacgtgaggtgttcaatactcgccccattttttccgcgtcgatatcgtaggcgagggtcacgtggtgcagtatggcgccaggccctccctctactggtgtgaatcggcgttgtgcggctccgccgagtttgccgtattgcgtggcgatgtcgttgagtccggcgaatcgtacgtcgagcccgagttccttaagcgcgcgcaccagccagaaatcgcagagccggtatgattcctcgatgcttatgccttgggtgaaatcgaacggcgcgtacaacgagtaggtgatggtattgcccggttcgatgaacatcgccccgccgccggtgcaacgtcggaccacggtgaatccttccttctgcgcgaccgccgtattgacttcgtcttcgagcgactggaatttgccgatgaccacggccggagcggcccattcccagatacgcagcgtgggttcgcgtttgcctgccgccacttcgcgcgcccatgcgatgtcggtttccatttgttcgttcgggtcgcgcggcttgtcgtggatgacggtcggtttcaggtcccgccagcgttccagatattcctcttgtgtcagcgcattatgcattcccggttgttccccggaatattgtttcgtggaccgcgcgatatttccgttgcccgttgcatcttccgcattacgcgattcactgcctgcgattgcgcggagaaaagcgatggcaatgccttctgccgtcatacccaccaatcgcacgttcggatagttcgcggtaatcgcttgcaatcgtcgcgtaatgtcgcgtgtgggcgcgcctcgctggctttgcagcaagttttcccaatcctgcaatagtcggcgggaatccttgtcatcgccgtcaagaaagaaatcgccgtcgatccgacattgttccacggattggatggaacttgcacattcgcggaaatatgctggaatgtcatcagaaagccggacggaaacccctacgagtttgccgcccggctgcttatacagccctctgcccatcaatcttgaagttcttggccgcgcccatcgcggtgccagttggacccgtagctggagcacaggatgaggactgcttcgatcagagcccagattccggaaatgatcggtccgatgaggatgatccatccgatcagggtcagcaacagctgggccacggccttgcctgtgtatcccagatagaagttgtgcacgccgagggtgccgaggaacaggccgagcaggccggcgacgatcttcgacttctgcgcgtagccatagccgggctgctgttgggtcgcctgatagtaggtctgctgcgcgtaggttggtggctgattgtatgcggactgcgtgtattggggctgagtcggctcctgataatagggggtctgcgccgattgtgcgtaatccgtaggtccgtacgtcggctggccgtagatgggctgtgcaggttgcgcaggctgagtcggctgcccgtaagcgggagcggccgagccatatgcggggacggacgaaccgtaggcagccgactgaccatatggctgaccattgccgtacgtaccgccggggatgttgttgccctgcgtacccggggcatatccctgcacgggctgctgcgatgcgtacgggtcgggattgcgcggctgtgatgcaggctgattgcagccatcctgcgactgcctgtaatcggcttgagttgaatcgttcgtcgcgaaatactcgtcttggccggaaccgttgtaatcggcattgttgtcactcatggtttcaacaatatcccataatttgccttgttgctttcatccaccctgaaagcaatccctgaaatccccctgaatatgcgaaacgcctgtcgaattcaagcatgaactcgatttcgacaggcgtctcaacaggcgaacatatccggcgcaatcatgcgttccggatcatatgtcacatgcgtgccagaatgtcgcgtccgacctcgtcggtggagcgggtagcggatcccagctcttcgatgtccgcttcgacggccgcatcgatcttggccgcggcgtcgtcgaaaccgaggtggcgcagcagcatggccgcagaaaggatcgcggcggtcggattggccttgttctggcctgcgatatccggtgcggaaccgtgaatcggctcgaacatggacgggtattcgttggaagcgttgatgcatccggaagcggagtatccgacaccgccgaccacggcacctgcctcgtcggtgatgatgtcgccgaacaggttgtcagtgaggatcacgtcgaagcgggacggattcgacaccatgaaaatggtggtcgcgtcgatatgcagatagtcgtgggaaacttccggatattcctcggcgaccttatcgacgatgcgctgccacatgtctccggcgttgacgagcacgttcttcttgtgcacgagggtcacatgcttcctgcgcttcatggccagctggaaggcgtaacgcaccacacgttccacgccgtaggcggtgttgatggaaacttcggtggccacctcgttcggggtgccgcggcgaaccgctccgccggcgccgcagtacaggccttcggtgccttcacgcaccacgacgaagtcgatatcacccgggttggcgagcggggaggtcacgcccttgtacagcttggacggacgcaggttgacgtactggtcgagatcgaaacggagcttgagcagcaggccacgttcgagaatgccggccttgatacgcggatcgccgactgcgcccaacaggatcgcgtcggtcttcttgatgcgttcctcttcctcttccggaagaatcgcaccgtcacgcaggtaacgttcggcgccaagatcgaaattctcgtaatcgaattcggcaacgccctcggccgccttctccagagccttctgagcccacggagtcacttccttgccaatgccatcgcccggaatgacggcgatggtgtacttctttgcagaatcactcatagcacgcgactctagtcaacgaatcagcacgtggacttaaaacgctcaactaatggacactccatgccgctttcctgtacgaaacacacgaaaagcatgaatcatacgaatctcacaaatcgcacagcctaatcagctggtaatacccatcacgccaagacaccaagcattctcataggagatctcctcccactgcttgtaccttccagacgtacccccatgaccagcctcaacctcaatcttcgccacggcatccacgcccgcacgctgcagtcgggccaaccatttcatcggctccacatacagcacacgagtgtcattcatcgacgtggtaatgaaaatcttgggaaaaaccgcaacccgcgcatcatttgcatcagacggcgcattctcatacggcgtatattccttcatataccgatacacgtccgcattatgcagcggatcgccccactcatcccactccgtaaccgtcaacggcaacgacggatcaagaatcgacgtcaacgcatccacaaaaggcacatccgcctcaacgcccgcgaaacattcgggagccatattcgccacggcacccatcaacaggccaccggcggaaccgccatcggccaccgtgcgagcaggcgacgccaaaccggcacactgcaacgcacgcacggcatcaacgaaatcctcaaacgaatgcttcttattgagcaaatgcccctgctcataccaagcacgacccatctcaccgccgccgcgaatgtgcggcaccgcataaagcacaccacgatcaagcatgctgatgcgagacaccgagaatcccggatccgaactgatctcatacgcgccatacccggtaacgaacatcgccgaatcacacgcaggcacatccctgcgccacaccaaggaaacaggaatgcgctcgccatcgcgggcggtaacccacaccctgcgctccatgtattcgcgcggttcaaatccaccaagcaccgtagcacgcctcaacaggcgatcctcgccggtcgccggatcgatatcatgcagttcgccgggacgcgtgtaactggagaacgagtagcgcatgcggggcgcatcatacgaaggattgcctcccacaccaatcgaatacaagcgccgggtctcccccggcatcgcatcggcggtcgcaccatccgatgaggtcatcgccttgcgggaaaccccatgcacggccgacccctcgccttgcgcggcggccaattggtcgagcgcgccccatacttcggcacgttcctcgttgatctcgtccaccgactcgtcgacatcccaatcgtcttccaacgcgtggggaaccagctcggtgaacttccatggacgccccgcaagaaaatcctccgcagcggcatccttcgtcatcaccgcaatatgcgtcaggctttccgcccggtactgcagcgccacataatgccggtgaatcgagatcccctcaatgccaagaccatgcgcgccctgcaaaatggctggattgcagggattggaatacggtgtgccgatcggcatctcagaagcgcccggttcgacctcgtcgccgtgctcgcatccgtacggcgaaccgacggccacacgcacgccctcacccaaacggtacgggggctcgtgggagcgcatgtcgatcacatcgatttcgaaattcgggttcaacgcattgtgatagaccacggcgagcggaatatcctcaccgcattcgccggcaccttcgaaacggctgaaactcacgtcgtattccacgtcctgctcgcgcggaatgaacgcgcggaattcgccttccggatcgtcggtggaaagcagcaatacctcggtggtagtcttcgacccggtgccgatcaccagattgcgttcgtcgaacgacaggccgatgccaacccagaatcgttcgtcctgttcgcggtacacctccacatcgtcgacgatgggagtgccgacgcggtgcctcatcaccgcgtatggacgccacgcgtcgtcgagcttcacatagaacacccattgcgcgtccggtgtgaagcaggcgccaccgatgcccttgaacacttccggcagttccttgccggtttccaaactgcggatgcggaaatcgtaacgttcgtcgccgctggtgtcggtgccgtacagcatccaacgtccgtctttggaaatatccatgccgccgatacggaagaaatcatggccttgcgcttcggcattggtgtcgaacaccacttgttcgccgtcgatgggcacgccgatttcaatggttggcggatcccaatcgtctgcgcctcgaataggcacacggcattgcaccgcatactgctggccctcctgggtgcgtacgaaataccagtagccatccatgcgtgtcggcacggacatgtcgttttcctgaacgtgcgacttgagctcgtcgaacagtgtggagcgtagggttttcaacggttccatgcgctgctcgcaataccggttctgcgcggcgacgtaatcctgcacgtcatgcgattccttgtcgcgcagccattcgtactcgtcgatgaaggtgtcgccgtggaatacgcgctccttcggcacacgcttcgcgatcggcatcccgcatttgtcttgcacgctttcgtcgctttctcgcgcgcccgttgcgccctgttcaccccgaaaatcagtcatgcacgcgattataccggcattgcattcccaatcccacgcggcacgcaccccctgctccgggcgtacgaaaaagtcagacgcccatctgttgtttcaggaacggcagcatggttttcatcagattcgagccggtcgttcccgtgaataccgggacatcggtgaccgggatcggctgcgtgaccgcacgccccgcaacggtgccgagattgccggcgacttcgcgtggagacaactgccggatgccgatcgccagcacacgccctgggtatcggcgtgcgatcgtggcgtacgtggtcggatccctctgcccgtcatcgccgatcagaatgaacttcatatcaggaaaatcagccatcaattgttcggcatactcgagtttgtgctgcactccggaaggaatgaacgttttcgggcgaggatcgaggtcgcgcaatagcagcggaccttccggaaaaccatggttggcgatgaaatgccggatcgagctttccacattccatggcgatgtcgacaggtagaagaacggcgcgtccgggaacatgtccgcaatgcggttgaacagcaggttcatgcccgcaaccggcattttcttctttggatcgagcagcagcagattgtaggcggctttcatcaggcttggcgcctgcgtgaccatgatggtgtcgtccacgtcggagatcacgccgactttcgtaccgctgggaatggtgaacaggttggctgtgaccggtttgcggctgcgtaccttgtatgacacgtcgtgcacgcccggttcgagcgaatgttcggccacgagatcgagatatcctgcggaatcggaggctgcgaattcactggagacattgcgctgcgcgtccacttcgtcgtgcacttcggacgcgcccacctgcacggtttcgaggggcacgccgtcgatggcgatgcgcaccttcgtatgcggcgaggggatggtgagcatggcacggatgccacgggtcagacgacccgcctgacgtttgaagggcccgtacacggttcggcagatcagtcgagagtaatgttcggtgccgtagccgacatatggttccacgcgcggataccagttgagattgagcaccatgcttgttgagaacgtcacccacttgttgaacgctctggtaatggtgcggcggaacagtcgtgtcagcggaggcttgacttcgatgcgttcgtgtttcgaagccgcgtcgaaggtggtgaccaccttgcgtgcgggaatgggcacggtcggcatgtcatcttcggatatggaatccggttcacgctggggcaacggctgcggttcggtcataaccccactataaaggcgattattgaattacctggtaccccagcgtgaaaatcagggatttttcagggaataccgatgatttcccatccaatttcccgaatcgtgccgttcactgagccacgatgttggcgtattcctcggaggaaagcagtcccggctcgtcatcctcaagttcgattttgaaaatccagccttcgccatacgggtcacccgttacgatgcttggatcgtcggcggcctcgttgttcacatagcgaatcacgccggccaccggagcgaccagcggcgtgaccgccttggaggattccagttccgccacctcgtcgcccgcctgcacttcggtgccgacttccggcagatcgatgtacacgagttcgccaagctggtcggccgcatattcggtgatacccaccatggccggctcggtggaagcatccacccacacatgctcgtcggaatattcaagatgctcgggcacatccagattcggcttgttatcgttttcttcgctcatgaaagctcattctacgtcaatcgtatgtatttccctagagcagtgccgaaacttgttacgggaggtcgtggccgagccattcttcgatcatgtagcgggcgatggtggccttcccgggagcttccatacgccctgccaccaactcgttcatgtattcgtcgcgggtcacccaacgcgcctgcagggtctcgtcgccgtccacgcgcacgtcggtggtgttggccacgcctttgaacgccatcatgagcgatgcggggaacggccatggctgcgatcccaagtatttgagttcgccgatgtctatgccgacttcctctttggcttcgcgccggcaggcatgctccaggttttctccggcttccacgaagccggccgatacggagtacagtccggtgttgcgccatgcgctgttgtgttgcagcagcagacggtcctcatggtccacgatcgccgtgatgacggccggttccactctggggaacagcagtcgcttgccgtccgcttcgctggtgcagcgttgcgcccatcctcccaacgccggttcggtcggagcgccgcatgtggggcaatgacgttggcgcgcatgccatacgcccagcgagatcgccgtcgtggcctggcctgcttcgcgcgcgctggcatgcggtgcgaatccgcgcagatcgacccagtcgaatcgttccgcagcgctttccagcaacgatttcgacgttttcgcttccggttcgtgctgttcgccgaacgcatcgtccgcgcccatatgctcgctgcttgcgaccaccgtctccgcggctttcatgcgagacacgtcaacggcgaccacgtgttcgtcgcgtttgccgccatacgatccaaggaatatggcgagcgccgtcggatgcgtgtgcagttccgccgccacgtaggcgccgggcaattgcgcgagacgcatatgcacgttggcgtagtccgcgatggctccctgtccgcgcggcaccgccaccatgccgtctttgacgagaatgaccttcgtgtccggctccagcagcgccgtgtcgaacaggtcgggttcgtcgcgtctcgaaacctcatagtcgatgtcgccttgcgcaagtggcaggaacggcagtgcctgggtcagcgccagtggcgagaacacgctcatcgattgcttctttccttgaatacgattgatagagcggatattttttctctattccgtattttcttttctatttttttatatcttttttgtatttctgattgcgatattgacggcagcggcggaaaataccggctactgcaccctgcgcaccagcgcgagcagcgcgtcggcaaccgcctgcggatgctcgtatgcgctgaaatgcccgcaatcgaataccaccgtcatatccgcgctcgtgcctgtcatcgcatcggcgatcggcgtcatcacgctcggcgggctcgacggatccttgtcgccgcagatcaccgcaaccggtgccgtaatcgcaggcaacacatcgttcagatccgggcgcccagccgccatgcgctcacgccatgcgatgccttcggcaggctgttcgttgatccacgtcgtgaactgttcacggtaggcggccgactgtttgatggtggaatcctcaggtgtggatgccgcaaatcccatcaccggctcatgcgtgcccgtcgattcgcatgcttcggcgatcgcgatgcgcttcgcgcgcatctgcgcggaatccgccgcggccttcgtgtcgcacaatgccaacgcggcaacagcttcggggtgcagacgctgaatgtcgagaaccagatagccgcccatcgaaaggcccgcccaaatcgccttgtcgtaaccggccgcatgcaacatcgcgacataggcgtcggccatatggtccaaaccgttcgggaaagcgccgtccgcgtctttgccgccactggtctcatcggaaggaatcggcccttctcccgcaccgggcatgtcgggaccccagatcgggaaccgtttcacaccatgttccacagcggccgcctccaacgcctccgcacattcgtcccacatgcggtggtccacggggaacccgtgcaccagcaccacgggaagcccctcgccctcgcaatacacgttattatgtaattcgatcgtcatcgtctcactccgttcctctcccctatattgcctatgtatctatcgcttgcgctgcctgcattcgcaagctgccacgcgctttcctggcgcccacggccgaccggtttcgacgtcaaccataagcctgtcggctacctgccggcccaagcgatcgcctgacgcacaatcgtgccatatccgttgctcatctggtttatgaaagtgtcgaggatctcgctgttctggttgacccattccacgtcaagcgtctcatcctgcggcttgcagtcgcccgcgatcggcaccacgtagcacaatgcgatcgcatgctggcgggaatcgaaataatcggatagtcccggcgtcgggaaaaactcggccacggtgaacggctgcagactcaccggcagctgcggcaacgcgatatcgcccaaatccttggcgatattacgcgccacggcctcacgcaacgattcgtgatagagcacgcgcccggcaatcagcgttcgctcgatactgccgtcgtcagacacgcgaagcaacgatccgacctgtgaaacacgccccagatcatcggtgcgcaccggcaccacaagcacgtatggaatcggcatttcgccgcgcatacggttgatttcgccggaagcaagccatcctggaggattacctattccgcgaatgaaatcctccggcgtaatgtcgtcgaattctccgcgacgacggcctgcatcgaaatcgccctcgtcgggcacttcatcattcatcactggcatagtcccattatcacgcatcttatgtgaattggctggaaaagaatgcgccgaaagacgattcttctgacagcggatattgcatatgccgggaatgcggcgggttggggcgcggttatatactccaaagcaatcgcatacgaggggcgtagcccgtcacgcgcgtcgatggaacgaacagcaaggagcaatcatggcaacgcatgcggtcacttcgcaggatttcaatcaggtcgtcgaatccaacgatctggtattcgtggatttctgggcaacctggtgcggtccgtgccgtgcgttcggcccgacgttcgaaaaggcaagcgaagcgaatcctgacatttatttcgcgaaggtcgatatcgaccagaatccggatctcgcctccgccgccaaagtgcaggccgtgccgaccttgatggtgatcaagaaccagcagatcgtattccagcaggctggcgcgttgcgcgcgtcggatctggacgatctgatcgcccaggccaaggagctggacgtcaatgcggccgctgccgaagaggctacggaacaggcgcaataaggcgaatatcaaaggattgcaaaggtgccgttcgatggcgaaacatcaacggcaccttttgctttgcacgcttgctttgcatgcccgctttgcccgcctgttacatatgcgctcgcccggattccatggcatggagtagaatgtcacgttggatatgcgctttccggcgaagcctgaagtggcggcgcaccgcatgccgtgcatgtgtgaattcgtcgaggatctgaacgcgcgtttaggagcagaatggctaaccacagcaagcacgcccgatcgtctaccttcgccatgccgagcaagtcctcgctggtgaagatcgccgcaacggtcgcggcggtgggcctgttggctaccggcggcattgtgtcgcgcaatctttacacctccgcggagcagaacacggccaatcaggtcacggccttctccgtcaccgattccgccgaagcatcccgtggcaacgcccgtgagctgctcaatggagacacctcgtacgtcaccgtgaagatcaacggcaagtcgcgcgtggtgcccggtaccaatttcaccgacgtaaagtccgtgctcgacgcgggagacatcacgctcgaaccggaagacacggtctccccttcgctcaccaccaaggtggatgagaagaccgtaatcaccattcagcgtgccggcgcaagcgttgaggtttccgacaccgccatcggtttcaatgtcgtcaagaaggaaacctcaagcctgccggaaggccaggagaaggttgagacggaaggcgaagagggcgtgatggaaaccacgaacctcgtaaccaagtccggcgacaccgtggtctcctccaatatgatcagctcgtatgtgaagaaggctccggtcgacaaggtcattctcgtcggcaccggctccacttcgtcgtcgtcctccagcgcttccgcgtcgatcggcaccactgtgccggcgggcgaaatgcagcagtgggctcacgattatctgctgtcgaacggctacaccgaagccgatttcaccgccaccgtatacatcatcacccacgagtccggctggagcgtcaccgcaacgaatccgagttcgggcgcctatggtctgccccaggcgttgcctggcagcaagatggtgagcgcgggcgccgattgggccaccaattatcagactcagctcaagtggttctggggttattgcgcgcagcgttatggttccattcagggagcctacacgtactggctggccaatcactgctattaaatcgcgattgatcatcattgattgattcgatgatgatatagtttgagctccgtaatattcgaagatattacggagctcaaactatattacgatcttaaatatcactgggatatcgccgatttcacagggcattgttggaaccgatcaccgtggcttccttgacgtcatcgatcttcctgcgcctgcggccgccgtgaccggccttcggaccacgcttgccgacggtgccgctgcggaccccgttcttggcatcgaagatgatcacgcgctcatcgctgtgatattcgccgtccagagcgaagaaggcgatcttgtctgcaggcacttccgggaaggtgaagaacttctgcgtcgcaacgagcaggtcaaggttgcgggtggtgacggaagacgacgtatcggcgttcggagcattgaactgaagagcgaaatcgtcattctcatcgcatacctggattgcgaacttgccgcgctcgtaattcaccagcagcttgacgtattcaggacgtccgagaacttcggaaacacccttggaaaaacgaacggattcaagcatgaccgtcatggtcaacttgccaccagttctttcgccaacttctttgaaaccatcaagaacggacatgtaaatccttcctttattgtaaataactacgtgaaatactgtacctcattgttaagaataaaacgaatcgaatctcggggaatatattcatattttcaagaacacaacataatacgaaaaaacataccgcagaccatgcttgtctcaatgagaaattcgatacggttcagccagcgcacttcctaagccaactcgatgggcacaccaccccttgtcaccccgacggttttccgctaaaaacagatgtggtaacccctacctcacccccgcactacgggttgcgcaaattgcaaatactttgcagcacagttttccaatttcatataggaagcgctgaaatatcgtgctttatgcatgcatatcatttgcaaaacggttcatataggggctatcttgcgcaactatcttttgcaatcattttcatttttacaatgattttctcagtaacgattttcattgaaaatccgccatttttcagcatcttttacactccaatcgggatagaatatacactacacggttgcagtattgcaaacgctatcaaagaagatgggacccccgtcgcaaagcagcggccacgataacggagccacaagccccgataccggcccaaacacaagaaaaagaaggatcaggaaggtcaatgaaacatcggaaaccaactcccgtctggcagaagctgggtctgcgcgtcagcaagaagctggcggtgggcgccacagcccttgccacagttttcggcggactggcagtcgccagcgtctccgcacaggcgagcaccgaccgtaacagttatgcggacaccgtaggcaacccgactttcgaagcagcacgcaaaaagtacggtctgaccaaggagatgaagaacggcgccattctgcacgcgtggatgtggtcgttcaacaccatcaccgaacatatggatgagatcgccgaagccggttacacctccattcagaccgagccgatgagcaaaatcaaggtgaacgacgccaacggcaagaaattcaccgaaaattggtattacgtgtatcagccgacgaacacctccatcggcaacttcgtggtcggcagcgaagacgacctgaaagccatgaccgtggcagcccacgcgcatggcatccgcatcatcgtcgacgttgtggccaaccacttcaccgccgactggaacgccatcgactccgactggcagaagagcgaatatttccatgcgcgcaactcctgcagcggctccggcggcgacaacatcgattattccaaccgttggcaggtgacgcactgccacctgctgggcctatgggatctgaacaccgccaatccggaagtcgccaatcgtatgcacgacttcctgaaaaccgcggtgaacgacggtgttgacggcttccgtttcgacgccggcaagcacgtcgaactgccgaacgaattcgacggttcgcagtattggaccaccattctgcagaacggctcgcaataccagtacggcgaagtgctgcagggcgattccggactggattacaaggcgtacgccaacctgtatgccaagtatggcgaaggcggcggagccacggcctccgactatggcaagaccatccgttctgcactgtggagcaagaatctcaatgcgggcaatcttatgagcttgcgcaacgggggcgtcaacgacgatcagctggtcacctgggtggagtcccacgacaactatgccaatagcgacaaggaatccacgtatctgaccaacgatcagatacgcttcggctgggccgtggtcggcgcacgcgcaggcggagcgccactgttcttcaaccgtccgaaggcctccggcggcaatcagccccagttcgcagaagcctctcagctgggcgacgccggcgatgacatgtggaaagacacggctgttgcggccgtcaaccatttccacaatgccatggacggcgaggccgaatacctgcgcaactgcggttccgaacagaacaacaactcctgcctcatggtggaacgttacaagaccgacaacaatgccggcaatgacggcgtgagcatcgccaacatgggcggcgaccagaatctggccggcactccgaccaagcttgacgacggcacgtacaccgatcaggtgaacggcggcaccatcaccgtttccaacggcaagatcacttccggcaccgccaagggcgatgcggtgagcgtgtacttcaacacgagcgtgaaggaatccgtttccgcgaccgtcagcaagaagttctcctccaacaccatcaaggtgacgctgaacgccagcaatgccaccaatctcacttactcactgagcaatggcaagaacggctccttcgttgacggcgactcgctcaccatcggcggcgatatggagatcggcgattccgtcaccctgaccgtcaagggcaccggcgccgaaagcggcgaagcgctcgagttcaccgcaacctacaccaaggttgaggttcaggcgaacacgatttatgcgacgaagccttccggctggagcaagatgtacgcgtacgtgtacacgggcgacggagcgaccgcgaagaacaacgcggcctggccgggcgtggagatgaccgcgatggcggccgccgattcgtgcgccaaggccggcacatacaagtatgaggttccggatttgggcgagggcacctatcgcgtgatcttctccaacggcagcggctcgcagatgccgggggccagccagcctggttttgaattctcgggcaaggtgagctgggatggttcgtccgcctcgctgacagccatcacctgcacggcaacgcctccggttatcaagaccgcggacatcaccttcagcgccacggccgacctcaagaccggcgagaccctgtacgcggtcggcgactggggccagggcaagggcaagacctggacccgcgccggcggcgtcaagctcgccaagaacggcaacgcgtacaccggcaccaccaccatgaccaagggccaggccatcaccgcccgactgatcaaggtcgacgcgaacggcaagaccacatgggacgagatcggcgacgtcaaggccaccgccgacaagaccaagaccgtggacctcaagtggaccaacgcggtcgagaacaccgtggacatcaccatcaacgcggccgccgacctcaagaccggcgagaccctgtacgcggtcggcgactggggccagggcaggggcaagacctggacccgcgccggcggcgtcaagctcgccaggtacggcaacgcgtacaccggcaccacgaaggtcggcaagggcaacgccatcacattccgtctgatcaaggtcgacgccaacggcaagaccacatgggactcggccaaggaccgcaagtccaaggccgacaagaccaaggcgctcggcgtctcctggacctccgacaaggtgaacgaggacggcacgatcccggacgactccgccatcagcatctccggcaagggcgtcgcggacggcaaactgtccatccagaaaggcaacctcgccgagctctacgtgatcggcacccaggacgccaccccgtccgacgctgtctggtggagtgacggggccgccgtggcggtctccggcatcggcaccgtctacggcgtccagaccggcaccgccaaggtgaacgtgaaggtcggcaaccaaaccgccaccatcaccatcaccgtcaagtaaacggcaaccgccgatatccataaaacatttgagccttggaattcaatatcactccaaggctcaaatcatattcaaacgcttctatacgcatgaaaatacacacatcaaaatcagcggatttagcataatcagctcaaagcgtcgtgcagatatcgctttgagcggctgcgcatgatatccagtgcaatatcggcattgcagaaatcgatggtttgtgaggtatcagtacaatcaacttcggaaaaatcagtgatgattctgtcggcgaattgtacttcctgcaggatttgaccgcgtcgggtgccgagttcatgctctttggtaccttccgtatacacccagaacggtttatggaagttgatggagaacagcgtgccatgataggagtccgtaactacaccctccgcatatttcaccagcgagaggaattcttccggccctgcctcgagcacattgacaagctcatcgcatttcggcacattgcccgcctgcggcgtcagcactgcgacaggcaggccgactcgacgagacagttcacgcagttgcctgaatacgccgacagcacgcttgggacgcagcagcgaataaaacagcagatactgttcgggcacgtgttgcgacttacgcaacggtatgcgttcctcccattcgcccgcgttgagcaacagcgtcggatcgcatacgtgttccacatgtttgccgcttacctgccgcagtttgccgcatgcggaacgttccctcgccgaaagcgcgctgaattccgccaacgccggtccgatgcgccgcaactcatcgtcggtcatggtggccggcgacgaagcatacgagattttcctgcagttcgcccatttcagcaggtacgggtccatgtacttccagtcgacgcgttccagctcgttggaatgcttgttgatgatctggtcgctgccgctcacggccacgtcgaatgcgtcagccagcgaattcagctcttccggctcctgatagcgtcgttggcccacatgtatgttcgtgctgatgaaccgctcgaaattgcgcatgcgcttcttgcgcagtcccgcaaccggcagcatggttaaatccgcgagggacgatttgaggcccagcccacgccaatataagcgttcatagtagcgttcgccctcaagcggccggtagtcgatgacggtaacgtcatgccccatgtccgtgatggttgattgcgtggcatacgcctgcaataccgaaccataattataggcagcatgatacgtgattagaccgataatattatgcttctcgtccatatttcctcgtcgttcaagtagttatttctttgttttctcgctattgcagaagcactctgctttctcattgttttccactgaattgcttatgacgcacccatgcgatcgcagcgctcacgtaataccatcgatatttcatcgaaagcaacgcgatttgtcgggtcacaggaaaacgacctccccgatatcgatcaagcggctgccgaaaaaccggcatgttcactacttttccatagtgattctttcgttcatgacggttccatggcgcttcgggattgaacagatcattgatcataatgatcgtcagatgaaataatgtgtaatcatcgagcgttccatcagatatttcccgaaattgacgaatggtatcgcgcattgtttcgatcgcagatattgttcgccgcacataatcgttggagaacgaccgcaccgccgaatccgcattgcggcggtattcgtacaccatttcatccacatagccgattcgattcgccgccgcgaccgcacggaacgcatattcggcgtcctctcccaaactcaaggtttcgttgaatccgtcgatccctttgatcagcggcatgctgtacagcttgccccaaacaagcgcgatacctcgctgcggtcggagcatatcctcgcataggtcaagacgcctgcgtccctcgaacaccatgtcagtttcagcataatggtgttcttccacacttggagacccctcgcctttgccgcccataatgacgtcaccagcggcgtcgggaacaccgttcgcatcggcatcggcacctgcaagcacgttgcggtacgcccccatcaccacatcgcagcggtatcgcaccgcaaacgcaagcatgccgtcgacggcatgcttggcgagcgcatcatccgcatcgaggaacatcacccactgccccgtggccgcgcgcaatcccgcgttgcgagccgcggagactccggcatgggcgatcgtttccgtacgaatgctgaccaatggcgaattccaattcgagatcggtgccgtttcgaatgccggctcaccatcgaatacaatcaccgcttcgatacggaagccactgccctgctgccgttgcagactgttcacgcaatcatgcaacgtttgcaacgtggcacggtagacgggaatgatcacactgatggtatggctcatcgtcagttcagctcccgtgtgatcaccgaagcatcataccggaacgataccggcgattcgatgctttccgggaagttgccgatcgccacgaacgcaatcagcgtttcgtagtcgggtacgcccaacagcttgcggatctcatgctcctgcttctcacgcatcatggtgttgagagggcaggcggccagcgactcgcattccaatgcggtcaggaacgccatggcgaacaggcctccgtcgatatacggctcgttgcgttcctcaacgcttacgaaactgcgcacgtccacgctgatcaacgccagcaccggaggcgcatcgtacccacgccacccgccctgcaacgccaatgcctgttcgatgaatttcggattgctgatcagcagcacgcgatatgcctgcctattgcataccgatggcgttttcatcgacatgcttacggccttacgcaccgttcccatatcaacaggggtttcggcatactcgcgtacgctggaacgccctgcgaacaatgctgcatagtcgagcgatgcgttgtcgcgtttgtctgcggcacgcacggttttcacgcccgcattgcccgcaacgtcggctttttcggcttgttcgacgctttcgatatccaccgaggccacttcgtcggcaaaccatacgcccacaaactcaggaatcggcttctccaacgcccgatgcttgcgcacgtatgcacgaaccacctgccgtgccgcgatatacgtcacatcgtcaaccggatagtcgcgttcccgccattcatccatcacggaacgcaactccccgaacgcggatctgccgaatcccgcacggaaccgtctatgcgacaatcctttttcaatacgatgaatgtaatacaccatagtgccgcgcaattgctcggattgccccacattccattgcccagcacagaatctcaggaaccgtttgcgctgccccgcatagtacgaagccaatgtcatgtccgctttgcatccttgcaatacgcgccagacgcgatgcggaacgatggttttgattcgctgcttcacgcccatgatttcacctttccttgttttctcgacgcaacgacggcaataccgcctgcaccttggccatgacttcccttgtaaaccagccttcacgcagcttctgccccaattgcgaagcccgtcgtaccattcgcgcatactcgctttgcgtcatgccgtattccacggccatggcctcttgcaacgattcgacggcaacgcccactccctgttcgactacgaatggtgcgagcgccgccttgttccatatgatcaccggcttgtcggctgcaagatacagcgacagcttatgcggattgttgacggtcagatatttgccgtaatagccgccgcaggtgtcgagactgtcgccgtcccagatcagaccaaatcgtccttccagtttgtctggcagttcatcgggtgcgacgattccgcggtaccacgccgttttgccgttccgccggtcatatttcggcccgtacagattgatgtcggctttggggaatcgctcggccagccgatacacgtattcggctttgccatggctgagatttcccgcgatatcgatgccgtgacgctgttccacgggcacaggattcgcttgcggcagcaggtaatcaaaaatgccgatctccacgatcggcacggtcgcgccgtacttgcgcaacacttcgctcatgcgcggattgtggctgatgagcagatccgcttcggtcacccattgtttgtcgaaatcggtgtaggagtagccgcgtagcgtttccaaatcatgaatcaggaaaacaaacaacgctccgcgcgctttcatcctacgcacggaaggcaaggcgtacagcgacaccttattgtacatgatgagcggaaattgcaccaacaccacgtccccgcagcgaacggttcgttccagccgatgccaatcggcaagcgtacgcccaacgcacaccagcttgtcgaaataccctttgttctcgccgggacgcacttcgaacggctgccaggattggctttcgagcacctgccgaatgtcatcgcgcgctttggatccagcgtgcgcatgatgcagcgaacgttcgcagatcacgtagttcgtcattgccaacctccattgtttgcatatcgtccgtcactcgcattgcttgcgccatgcgcgttattctcatcattcgttttccgtacatgcagtcggttgaataccggctgaagcatggccataacgaatcgttcgcggcacagcagcaacgcgatgccatatatcagcgcgaacaggaatccgccgaacatcagccacaggaaggcgttccatgtctcggcaccgcatatcgcgatcgcgccccgcgtaaggcagcctgccgcaatcgcactgagcagaatacgtatcggatcgatcgacgtgcgaatgccaaccaaaaacccgcggcacacatatgagcgcatcgccagcatcaacgcttcgcacaatgaaatgctgatggcggaaccgaccacgccgagctgtggaatcagcagcacgtttgcgagtacggccaaggcaagtccgatcgcgttcaccatggcccatgtacgttccattcctttggaaatcatgacattcgcaagcacgatattcatggccgaacacatcaccgcaataccgacgaatcgtagcggaaccgcggattccgcgaagtcagcgccaccgagcaatgccacgatcgggtcggcaagcaatatcagcagagcaatgatcgcggagccgaataccataacgaaattcatatttttcgcgatcagttcgcctgcctgccgctctttgcgccgcgcctgataatacgaaaggcgtggcagcatcacgttgccgacggaattgacggcggtgacgagcacggatttgattttggataccagctggtacaggccgaccatatcggtggtgccaaggaagccgagcatcacaatgtctacttgaatatacatgccggatgaaatggatgcgatggtgaaccatagcatcggtttgaaatggcgggaaatattgagatgtccacaattgcggaagtccacgaacctgcgtagccgcaggagattgagcacgttggatccgtacccggccaccaccacgatcaggccgtatatcgcgtagtcgccgcgctgccgtacaaaagcgaacatgagcaccaatgccagcagtttgaaacatacgctacgcacggtgatgtattcgtattgttccaacgcctgatagaaccattccacaccgaacgaggaaagccagatggccaggccgaaaagcgcgaacagcccgaattgcgtgttcattttcggtacggtgaacaggcacgccaggtagaccgcgaacaccatggtggtggagcatgccagaataaccagcaattccagcaccgtacgcgatagttccgcgcggtcgtcgcgtacgcgagcgcagacgcgcactccgtagtaggtaacgcccaggagggccaccagcgaaaagtatgaggccacggattgagcgaacgccacatgcccggtgccaccggtggaaagcacgcgcgacacgtatggcacggtgatgagcgggaagatcactgacgacgtggtgacgatcatgttcatcagcacgttgaatttcacggatcgaatgcgcacgtcggttggatgcttggccggcttgatggacggctgcccgaccggcttggtcggctgacgttcaggcataaagcaccacccgcttggcgaaggcgcgtttgcgtatgcgcacggagttcacgaagaatatcagcaccacccaaataatgatgtttctgagcatgatctggttgaacatggttgacatccaacggttggagaaaaagctgaacgcacagcaatagccgatggcaccgtacagcatcatcgatatgggaatgcccgccttgccgtattgcaatgcgaaaaccgcgctttcatagcaaagctgagaaagtgcggcgatcagcacgatggcaagcatcgcacccgcgatgccccagtcgaaaatgaatgcgtaatatgtggtgaatacgttgccaagactgcgctcgccataccgttggaagggttgccattgcatccagtcaagcacggttttgccgaatatctgggggaacgaggcccgggtggaagccaatgtcatgtctccccattgcgtggatttgaccgccaacgaaggcgacatggagttcgtgagatacgcgtctaggttttttatcggcgctccaatgtagatggacaggtattcgtacatggtcgagtcgcccgccttgcgtcccatcagcgacagcagtggcttgaacgaagccaatcccacgagcgcgatggccacgaatttcaacacagtgcggaagccgagccgcatgcctttccaacggttgttctgcctgcggaacaacgcccagtatgtccatgcggcaacgccaagctgaatgaggctattgcgtccgccggaaatcaacgtcatcggaacggccgccaacacattgatgaccgcaagataatcgttgtgcaacgaacggaccaccacgctgcgcatggcgagaaacagccacgcataggccatggcgttggtcgccagatgcagtagcgagggaattccagagagggccacgcctttggtgctgaatttgttgagtttgtcatacaagccgatggctttgtccagagagccgtctcccccgtagggcagtgtcaatgagattatctgccgtgacacgatcagcaatgccaaaccggtgaacagcaggccgccaacgtacacccacatcggcagaacgatatcttgcggctcaccgtattcccgatgtgctgtccgatgtccgacgcagctgcggaaaaacaccttcacaccgtaagccgtcaatgcgaatgcgaacgtgccgaatccaaccacgaagcaggtttgcatcgacaggtcgaaatcccaggtccggtaattggtgagtccattgaataccgcgagcgtgaatccgaccacgaatagtatggatggttccgcgaaatccccgcgatatgccactatcagcagcaccagcaatgccagcaatgtcaagaacagtatggtcgaggtcatctcatcaccatgcctaatgtgatgcgatttccggatgccgtcgcttgtacagcgcgtacatcatgccgtacagcgtcggagaggtggccaggagtttccattgcagcagttgacttttcccaatgattcccttgcgttccaccattggcagcaattcgcgcaattccgtacgcgcataccgttcgaattgcgcccattgcttgcgttgatgcgcgagcatgatgcgattgcaggtaccgacaatggattcgagatgcccatatgcggcatatgcttcaacatgcggatatttggttcgcaccaagtcgagcatggctccggtggattgtgcgaatttgtcggtgatgccatgcgactggctgttttccgacattctgtaacggtacagcggcgtggaatcgtatacgatgcgatccgccttgtcgagcagctggtaggtgaccggcgaatcttccgcatagacggcgtcgagcgggtagcgcaggttatcgaagagttcttttttggcgagtttgtcccacgcggtcacataaaagtagccatgctgattcacataggcgaatgcttcctgcgaggtcatgacgattttcttgtcgggaaaagcgttgcagtaggtgctgccgtcagggttttcccgttcgtacgagatgatcgacaggtcggcgtcggattcctgcagattgtgcagcaacgtgccgaacatatcgggaagcacgtaatcgtcggaatccacgaatccgatgtattcgcctttggcaaggtcgagcccggtgttgcgggccgccgctaagccggcattgcattggcgcaccgcacgaatgcggttgtcacgattcgcccaagcattgcactgttcgccggaggaatcggtggatccgtcgtcgaccagtatgatttccaatcgttcgtaggtttgcccgataagactttccacgcattggtcgagataccgttccacgttgtagaccggcactatcacgctgatgaggggttgggtcgaaactgccataagacctgttttcagcagcttttcacgtactttttgcctacgaatttcgccataaggaaaccggacccctttttgatccagtccactggttcggggctgatgataggcatttcgacgtacgggtaatggttggtttccagccatacatcgaagaggatttcgctgatgcgtccgggaaatcgcatttcgaagacgctgtatgagcttgaatcgatatgcttggccagttctccgatgatgggaaacatccacgagcagtattcgttgatgaggtctttgcgcatcacgaacatgttgaacaggtgcgccgaggttttgttcatttgcgcgtcgaatgcgtcgaggtagtcggaattggtttgcgcgataatgcttcgtgtcgcatcgagctgcccttcctgcatggtgtgctcgtaatgtgaatatacggtttcgatatagtagttgcgtcgttccggcacaatgatttcgcacgtatcgagcagacgcgcatagtcttgttttcctgcgatgcagctgaagcgttcgttttcgtctccgtggcgtttcgcactgtcatttttggcaaaatgacggcggtagtgcaccaatccctgatagtcggcatcgcagtttttccacatccaatacagtccggtcagttcggaatattgtgcgttcaactgcgaaatattatcgccggtgttgtcgcacgtcatacccaaatcgacgttcggatgcaacgccctaccgacctgcaacggcatatatacgccgtcgatcggcatacggtacgccttatgcgtggccacggccaccgtgatgtcggagtccgccatcactgtcatcccttctataccggacgcgcactactgccaaagcacgcccttatacttcaccctcccccttgcctggagggtacagcatacgttttcattttatctcaacagttcatctagatttcaccaaacgtcagacactcccgttttacaaaccccatttttcaagctttttcaagattattttacaaattatcatgttttgcaagagattgcagacgtttgcatacacgacgtgaaaacgaactgatttaaagctttaatcacaccccacacacaccatccaacacccccgatatggcaatttcaggatcgcctctttcataaatattgaaaatctcgtcacaactgtttcattactacttcggcgtttcgctgccatcatgttgggattacaagaaaaaacgtttgcagatcattgcaaacgattatgaaaaacagggcgcacgactccaatatcacatattgaaatcgcacgcccctgagatctaccggtcagaccggtggatgtatggctttatgaaatccgtttgattccttatttgacggtgatggtgatggttgcggtcttgcccgcggccttcacattcacctttgcggttcccgtctcgacgccgtacacgacaccggttccggaaaccgccactgccgcgccgtcgctccaccacatgtcgggatcacccgtggcgcccttcacggagaggttcgcgagctggcccttctggatggtgagcttgccgttcgagacgccgtcaccggtgattgcgaacgttaccggcacggtgccgtcctcgttcacggtgttcacatcccaggccacgccgacggtcttggccttgtcggcggtggtcttgcggtcggtggtcggatcccacgtggtcttgccgttcgcgtcgaccttgatcaggcggaaggtcatggacttgccggtcttcacgttcgcggtgccggagtagacgccgtcggctcccgtggcggtcaggcggatgccggaggcgcgggtccaggtcttgccgtcctgaccccagtcgcctaccgcgtacaggctttcgccgctcttcaagtcggcggccgcgttgatggtcacgtccacgctttgcgaaacctggcgctcatcccacttgagggtgagggtcttggccttgtcggcggtggtcttgcggtcggtggacggatcccacgtggtcttgccgtcagcggaaaccttgatcaggcgcatggtcatggactggcccttggccacggtcgcggttccggtcagttcgccgcccacggcagtgagctcgacgccaccggcgcggttccaggtcttgcccttgccttggccccagtcaccgaccacgtaggccctctcgccggacttcaggtcaacgccggtcgccttgaacgtgatctgcacgttcttgtcgtcgtcaggaggcaccaccacggtgcaatccacggccttcaacgaagcagacgaaccatcccacgttacggtgccgccgttgtagtcgatgcccggctgccgggagcccggatactgctggctgccaccgtcgttgaaaatcaccttcgcgccggacgcgagcgaatcaggcacctcgtactggtaaccggtctggtcgcagttgtcggcagccaccatctcgacgcccggccaggccgcgttgttcttcgcggtcgccccgtcgccggtgtacacgtacgcgtacatcttgctccaaccggaaggcttggtcgcatagatggtgttcttcgccaccggcggtgtcggaagcgtgccggtcaccgtaacggtgatcgaatcgctctgggaaccggactttgcggtgatggtcgtggtaccggccttcttcggcgtgaccgtaccgttggcggaaaccgtggcgacggccgtgttggaggagctccagctcacggacgaaccagccggatcggtggtggcggtcagctttttcgcaacggcgccattggaaagatcagtggtgtagctgccaccgttgatcttcacgctggtcaccggagtcggatcttcatggccaccgatgttggccatggcaacggtgaacgtgtcttcgtcggacttctcgtaggagttgttgacctgagaggaggtgtccggcagatcggcattgtcgttcattgccatgtcatacggcagcgaatccattgcggaaaggccgaaggtggctgccagttcaacgccgagaccgtacttttcgatatggtccgcggtggtgccgagttcgctcagcggaatggcgatctcgtagtgatcgtccatgcctgcggagttgtggcccagatcgttgaaattgacccactgtgcggagccttccttgtcggcgctcatgtcgccgaccactcgaccgttgctttcaccccagccgccgttgatgccgatcacctggctgctcaggatgccgttgccgtaaccgaacttgacgccggaagccttggtgttggtcttggcgttggctgccggaccatattcggcgttggaatcaagacctgtagcgtcgcccttgtagatccacggaccgttggaaccgttggtggaaatcgtcacgaccttgttgacgttctgctcaccgctccacttgatgccggaagcccacagggttccgccggtggaaagtccgccgtccttgcccactcgggtgctttcgtccttcgtgtcgatggcgatgtggaacggcagattctgcgtctgccacaggtggccttggctgagcggataatcgtcgccggtgtcgaccacgtcttgcacgttggtcatttcccacatgaggtacagattgtcgtcatcgtaggcaccatacagtgcatacagatcgatcggcacctcatacatggaattcggtcggtagacgcgcggatcgtcgttggctgcgccctgtgcgatcagcatggagctgtcccaatcggagatgctcgcgtcttttccggcattgaagttgatggttttcttcacgccgaagccgactttgttcgtgccatatcgcgaggcgaggttctgtttggcgacttccgtcttggtcaccgtggtttttccggtgagtttggatccgtcttccgtgcttgtgccggtcacggtcacggttacggactcgcccacggagatggagctgcccacggtgatgacgtcaccgttcttgaaggtgccggacttgccttcggaggtcgtgtacttgaggttttcggccttgcttgcgcgcagggtcacgtcaacgctgcttccgctgaatgttgcggaagacggttccgcggaaacgtacggcttggcttcggccttcagatagtaggcgctgaccgcgttgcccttggcggtgccggaggtgatcttgccgccggaaacggtgatgcttccgccgttgacttcgtccggatacacgccgtcgtcaaggttggtgctcatgccggcgaggctctggtcgccgcccatgttggcgattaccacgccatcgttggcggtgccgtccttggtgaagcgttcgatcatcaggcaggacttgttggcgttgttctgatcggagccgcagttctgcagatattcgctcttgccgtccatggcgttacggaagtggttgacggccacgaccgacttgttcttccacatgtcgtcgcccgcatcacccagctgggactgctcggcgaattgtgcattggttccgccagagccgaccggacggttgaagtacagcggtgcgccggccttgcgggagcccacgatcgcccagccgaatacgatctgatcattggtcagatacgtggattccttgtcgccattggcatagttgtcatgcgactccacccaagtgacgagctggtcttccttggcgccgccggtatcgatgttctgcaccatcttggtgctcagattgcctgagctgatggccgcgcgcacggacttgccatagttggatgcggtgttgccgccgccgtcggaggaattgttggcgaacaggtccgcataggccttgtagtcgaggccggaatcgccctgcagcacttcgccgtactggaactgcgaaccattgctcaaaatggtgttccaatagttggaggtcttgttgtcgaacacttcggtcggcagttcgacgtgcttggcggcatcgaagcggaagccgtcaacgccgtccgcgactgcggtcttcaggaagtcctgcatgcggtcggccacatactggttctgcgtgttcaggtcccacaggccaagcaggtggcactgggtcacatcgcggcggctggaatagttgatctggtcgccgtcgttgccgccgcagttggaacgggagtggaagtagtctttgttctgccaatcggagtcgatggcgctccagtcggaggtgaagtggttggctaccacgtctacgattacgcgcacgccgtatttgtgtgcagtggcggtcatttccttcagatcgtcttcgctgccgaccacgaagttgccgatggaggtgttcgccggctggtacacgtaataccagttttcggtgaacttcttgccgttggcggcgacttccttgattttgctcatcggctcggtttgcacggaggtgtagccggccgcggcgatttcaggcatatgttcggtgatggttttgaacgaccacatccacgcatgcaggatggcgccgttcttcatgctctcggtcaggccgtactgttcgcgggcctgctcgaacgtggcattgccgaccgtatcctggtagctgtcacggtccgaggcgagtgcggtggaggccacgcccatgccgcccagcatggtggcgacggccgcgactccggcggcggctttcttccacgttttgatggtgcgggccttgcgggccgcttgcctgcgctcgacgcgggtcatcggttcggatggacccccgtcttgcgggggctgttgcttagtgaatacgtgcgcaatacctgcgaacgtacgcgaacttattcgcactttgacctcctgcttccttgcatctttcctttgaaaacgtttgctccttagcgaacgtaatccttaaaatatcacaaatttttggtgaaaaatgagtgatttttaatgaaatcgacgatgaaaaatgattggtttttctgcttttttacaaacgctttcagcaaggttgtcccccatccttcgacccccgatatacgacatgcctcgaaacagccacatgcaaacgtttctgaaaatcgtttcaccgcatgcacccgtcaacagcctttcccccgcttcttcacccctcttcagggcaacgggtacaatacgaaatcgtcggaaaacacgaagaaacacggtaggaaaggacagacccgtgaccttcaaccgctacatcctcttccgcatggtcgttgaatttgtgggagccatcgcctgcgccatccaaatgttccagcatcacacgtggccgggcatcatcaccatgggcgcgttcgcgctggtgtgggccataggcgagatctggctgagcacggtgtacaaccgcgcgcacccccgccgcgacgagctgtccgacgagcatcaggcgacggccatccgtttcacgttcttcgtgcttgtggtggcgctggtggtgctgggcttcgcgggcatgatcgccacactgttcaggcatgcgccgttcaccgttcccgccatggcgttgccgacgttgggcatgctggcgctggccatcgccgacgcccgctacctgtggcttgagcatgagggcgggaacaccgatgaagactagtttgaagttcaaacgtatggaacgcggcttgaaacaggccgatcttgccgacttggtgaacgtgcgccgcgagacgatcgggcgcctcgaacaggggcagtattgcccgtcgctacgccttgccatggatcttgcaaaagcgcttgataccacggtcgaagacctgttcagttttgacgacgaagagtgacgcttcggcgtgttgcgtttgtaaattcttatcaaaatggcgattttccaacgaaaatcgccatttttcatattcgggggcatgtgcgaacgtcgtcacatggtgtgacaacgccgtcacatatgtgcgattcacctcacatcccccgagagcgcggttctcaacgggggcgtatagtcaaggtcgtagcgggaaaccactacggcaaaccgctgaaatgtacgttatatttagagaggaatcacgattatgaagaagaagatcgtcgcaattctcgccaccatcgccgccgtgttcggctttggctttgccgctaacaccgctatggcttatggcgcgaccggcaccgtttccggcaacgtcgccaccttcacgtttacgggactgactccgggccagcgctacgtggtgtcctacgatgacaccaccgtcgagaacgtcaccctggctgccaccaagtactccaacgctgccccggcccatgaggatggcaccctgaccgccacctacaccttcaagtctggctttgctggcaccatcgcatcttccatctatgcagtcgatggggcagacaagccgaccggcgccgctctcgcttccgcctccgtgaccgtcgccgctaccggcgaaggcaccgccaagaagaacgagaccgcttccaccggtgctgctatcgctccgtacgttgtggccgtcgtgctgctggctgccgctggcatctccctggttgccgttcgcaagagctctgctcgctgaacaataaccaagtagatacacaccatatctatgtttcatgaaggggcttgggttttcccaagtcccttcatttattcgaaaacaagcatcgtaaaaccgattgttttcttttttcaggaagagatcatgaaagtcctgtttatctgcaccggtaatatctgccgctctcctatgggagaactgctcctcccccaattcatgcccgatcttgaatccgacagtgcgggcacacgcgggctcgtttcgcacgaaatcgcaccgaacagcaaaaggctgctcgaccagcatggcatcgattccagcagcttccgcgcgaaacgagtcaccccgcaaatcgcgcagggcagcgatctcatcctctgcttcgaacacgagcagcgcaaggaaatcgcggtgattgcaccaaccgcggcccgtaaaaccttcctcatcaacgatttcgccaacatgtgcgtctactgcaaggaacaggggtacatggggggtaatacccggcaggaaaaactcgaatcggtaatcgacaacgcaagcatgatccgaccgatgatccccgataccaacaatgtggaggatccgatcggcaaggacttcgccgtatatcaggcagcgtacaacgaaatctgcaaggctttgcagaccatagcaagcgccactgcctgaaaacgttgaaatatcaacgaaccaagctagaaagggtgcccacctccctccatgggggtgctctttgctagtatggaacctaatcaatatgatgtgacaaatgtcgaggggaaacatggctgcagcagaaagcaacgtgccagcaaccaatcaggtggtcgtcgaatccaatgatacggaagacgacggcatcaccttgatggatttgttccgtatagtccataagcatcttctggtgggcatcatcacgttcgtggtggttttcgcagcggtgtgcgcatacacattcctggcacccccgaagtattccgcgaccgcgcaggtgttcgccacctacagtgattcgtcggtgcaagacaacaatatttccaacatcaacagcgccagcacgtatatcaccaaccagattcagtcgtatccgacgctggccaccacggaatccgtgctgaagccggttatcgacgatcttggcctcgacaccaccgtcgcgaatctggccgggcagctgaccgtcacgaacccgacgaacaccgcgttcgtgaacatcaccgccgaaacgggagacgcgaagcaggcttccgacattgccaacagcgtggcggaatccctgagcaatgtggtggagaagtcgctgtatgcctccggcaaggagtcgccggtgaagctttccgtggtgcagcgcgctgcggagccgatctcccccagctccccgaaggtggcattgtacttggccgtcggcttggtggcaggcctgattctcggcgtgttcgctaccctgatccgcgatcttatggcaacccgcgtggaggaagccagcgatctgcaagacattatcaacgcgccgatcatgggccgcatccccaccgacgaaagcctgcagagcaacaagccgatcatcgtgtcgaacccggccggccgtatcgctgaggaattccgccgtattcgcaccaacctttccttcacatcgaaggttgaaggcagcgatgcgcgcatgatcgtcatctcctccgtcggaccttccgaaggtaagaccactgtttccgtgaacgtggcggccgcccttgccgaaaacggcgccaaagtgctgctgatcgacgccgatttgcgtcacccgtccgtagccgaacgacttagcctggaaggcggcgccggcctaacgcacgtgctttccggccaggccaccgtgaaggatgtggtgcagcgctattggaagccgaacctgcatattctgccggctggtccgaagccgccgaacgcttccatgctgctgaactcgaagaccatgaccgaattgctcgacgcggctttgcagacttacgattacgtgatcatcgacacttccccgatggtggtggccaatgatgccactgtcttcggctcgaagagcgacggtatcgtgctcgtttccggtcgcgacgtgaccatgaagcgcgatctgaaagacatcgccgtgcagcttgacaacctcaatgtgccggtggtgggcttcgtattcaacctcgaaaaggaacgcaagtcttccacgaacggcaattactactattactactattacgacgaggatggcaagaagagcaagcacgctcataagaacagccgcaagaagtccaagcacaactaagctgctgggcttcagggtttccgccctctatcgcgagtcggaaaccagtctaagtaaccgaaaaggggttgcagcaaatcgtcaagattcgctgcaaccccttttccatgcccaaattttttgccttcagccggctggcccgcaacttcgcatcagctgcggaggaggatttcctccagggcgccgatcaccgcatcgggcatgccggaggtgacaaacagctcgttgctgaaacggggcgcggtatcgaaggtgcgcagagccccgagcgcacgcactccttgctcacgaatcgcctgcatcgcatgctctttggaaatgtacggcatttgcgcatgcaagagcacgtcaagcacgtcctgttcgactgaattctcagcaatctgcagtccgtctgcaatcgtaacgttcaagcatgcagtagacggtacgtcgcgcacaacgaccgacagactcaacgtctgctgatcgtatgtaatttctgcagtattgcaagctttaccgccaatttcgatacgaacgttctgcgtgtctggctgtgcaactccacggaacacaatctcccagttacgctgtgccggaatggcttcagcacagccttccaccggactgatggtgaactgcgtggcattgtccgtattcttccagtcaaggctcatgcgcgtatcggcaacatgagtttggccatcgcaagactcggcagatgcagaaccggaagcagcagaggccacagaaccatcgtcttccttgagtgtgaacgaaccgttcgcaccggggaacaccagcacctgcagggactccggattgcccagatcattcaccttattgccctcgccaagctgctgcaacggcacgataccgccagccttggcaaacaccggcatacggtcgatcgcacgccacacttccaaacgacgcccggactctcctgccgaaacgtaacggcgaccatcgaagaagtcataccattcaccttgtggcagccatgcttccgtgctacccagctgcgcggaatcgtcattgtcagaaacaattggtgcaaccagcagctcagtgccgaagcggaattcatccggcacctcgtacgcctgcggattgttcggatccgcccaatacatcggctccaccaatggcatgccctcgaacgcggcgcgatagttcatggtgtacaggtacggcagcatcatatggcgcagtcgcagcgaacccaccatggaatcgcgcacttccgcggagaagttccacggctccttgcccatgaactgcgaattgctggaatgcaggcgattgatcgggctgaacgtgccaagctggtaccaacgggcttccaaatgctcgttacgatagccacacatatgaccgccaatatcgtgactccaccatccgtagccgatattcgacgcggtagcagtgaaatacggctggaactgcaaggattcccacgtaacaatggtgtctcccgagaagccgaccggatagcggtgcgaacccgggccagcataccgcgagaaggtgagcggccaacggttgttgcgttccgtgcaactcacgttgcgatcggattgctcgacatgcatttcatgctcatcgcgagcgcccggctcggcgcacttttcgcattcgcagttctcatttacattgcgttcggaagaagtctcgtagcgcccggaatccaggtagtgcaagtggttgagcacccacagcgggtcaagtccgggctggcgggtcacgccgccttgctgccagtcgagccaccagaagtcaacgccttcggcttccatacgatgatgcatgtcgaagtaggcgcttacgaaatccggattcgtgaggtcgaattccactgcctcttcggttgcgggatcaatgccgacgcgcttggccaccgcctcatagtcgtcttcgaacgcgcgcacgccgtctcgcggatgcacgttcaacgtggctttcaggccgcgctcgtgcaagtcgcgcaagaacgcctcatgatcgggaaacagctgcttatcccacgaatagccggtccaaccggaaccgtatttcggatcgacatcgtccacgcggtgccagtccatgtcgatcacggatgtggtgaatggaatgccttcgcgcttgaaccggtccatgagctgcaggtattcgtcttgcgtgtagcggtagtagcggctccaccagttgccgagtgcgaagcgcggcagcagaggcgttggtccggccagcttgtagaagtcttgcaccgcttcggtgtagcggcggccatagccgaagaagtagaagtcggtttccgcgtgatcgcgtggcataacccaagcccccagcggattcggtttgccgttcacttcgtatgcttccacgatcacgttcgcggcggaatcatcgagtaccgcccatccgtctcgcgaaatcacaccatcgtccagaggaatttcgccgttcgcctcgtcgagcgtgcgcgcggtgcctttaagattatgcttcggctcgtcgccgtaatgccacgtattgaactgggtgtcggccacgcccttgacgactacgctcaagccttctttgctgaatggcttgccatcgtacgtcacatacagcgcgggggtgtcaacaatgagcagtccgtcgcgatgcgtcaccgtgaattgcgggtcggcgccaaaatcgcggttgaccaccatttgcgtgagattgtcctcaaattcgccggaatcagaccattcgaaacggatcagcgattccgttagaatgccaatcctccaatgatccccttgtaaaaccgacgattctcgcattttcggacgtgccttgcgcacatagtcgacgaataccgtgccggttgcgttatctaatgcgttgtttgccatgctactcctgccttacttgccactgcccgtcgcaatacctgcgatgaactgcttctggaaaatcatatacacaatgatcactggaacaattgccaacgaagtcgctgcgaacaatccgccgtaatcggtgccgtattgtccgttgaaggccttcagaccgacagcgagcagctgcttgtgttcgtcagtgatcatcaagaatggccacaggtagtcttcccaattccacaggaaggtgaagatggcgagcgccgcgatggtgttatggctcattggcagaatgatgctatggaagattctggtttcggatgcgccatcgagttttgccgcttcaatgagttcgtcagaaattcccgagatggattggcggaacaggaagataccgaatgcgctgatcatgccaggaagcacgagcgacgtgtaggtgtcttgcagaccccagttggtgaacatttcgtattgcggaatgatggtcactgcccaaggaatcatcatggtgctcataacgatgccgaaaagcaggttgcgaccacggaatcgcattttagagaatacgtaaccaagcaccgcacttgtgtagattgcaataccggttttcagtactgctacgatcagcgagtttgcgaacaatcgcaagaaattgaacttttcttggatgctcacataattgtcaatcgtggatggcttagggaataatcctccggtcactttgacgatttcgctatttggcgcgaatgatgaaatgaacatccaaacaaatggaacaatggtgatgatggcggcgatgaagagcagaatcgtaagaatgatgccgccaattttacgtgatttcatgccagttcctccgaatctccagaaaccttgaacatgatgagggtgagcacaccagtgaacaggaagagcacaactgcctgagctgacgcgacgccgaagttgtatttctggaatgcctgatcaaagatgagatagctgatggtgtaggttgacgtgcccggaccgccttcggtcatgacgagaatctgcacgtatgcctgcaggtagctgatcagtgacgtgatgacaatgaacaaggtggttgatttaagcaacggcagggtgattttgaagaaaatctgcactgagttggcaccgtcgatggcggccgcctcgtacacgtctcgaggaagattcatgagaccggccaaatatagaacggtcgcgtagccgaaatccttccaaatggtcatgatgatgactgccggcatggcccatttggtgtcgtgcagccagttgatgtcgagtcctgtgattttgtttaccatgccgaactgcgggtcgaacatccacatccacacgaaagagactgccacgagcggagtgatagtcggcatgtagaacagacctcggagggtgtctttgcatttgacgagtttggcgctgagcagcagggccaagccgagaccaagcacaatgcggaagagtgtggaaacacctgcgaataccgccgtgttccccatggaagtccagaaaagtttgtctgtgaggatctgtttgaagttgtcgagtccgacccaatcataagtgccaatcagaggattccagttatgcagactgcccgcgaaggctttaaaaattgggtaggccaggaaaatggcgaaatagaccaccaagaagacaacagccatgttgcgtagggtgaaaattctcgataccagagattcaccatttttgtttttcattgaatctcgcctctctgtgagccgattcgaccgttttgttacgcaatacggaatgtcagatcgaatcgaataagaagattgaacgtatctcgtagataaaaaggcagtcgcggcgcggaagaagaatcgtaccgcgactgcccggattggaaaagggattggaaaggatatatcggtattacttatgttcgtcgaagtaagcgtacttgctttccattgacgtgaagtcagagctcttcatgtcggtatccatctgattctgggcctccttgagagccttatcgatggacatgccgttctggaagacgttctggaaagcagtggtgccgctggattcaacggtggatggtgccggtcccggccagatcagtcggtctacgcgtggctggatggcggccatgaccggcttggagagaatgtccttgtcgttctgcagcgaggtcttggctgggaaggagttcagttcggataccgcttcacgaatgtaatcatcgttggcgagcaggtacttgatgaagtcctgggcaacggcctgctgctccttgctctggttcttgttgacgcccggagtggattcgccgttgtaacggtcgtatgcaaacggagtgtcttcggagaaggttggggtggcgaacacgccgtagtcaatatctggatacttttctttcagcgtaccttccatgtggccccaagcgtagatcatcgcagactggccgttaccgaagctttgggtgtaatcgttgccgaagtcaacggatccgaccttgtacttgtcatacaaatccttgaggaactgcatgttttctttggtcacatcgttgttgtagttggctttcttgccatcttcgctgaagagcagttcacccttctgataattcagaccttgatagatggcgctgtaggcgtcgccgttgaagttgaagccggcctacgtcatcttgctgccgtcggttttggtgagcttttgggcgacctggatgaattcgtcccatgtggtcggaatgtcggcgtcggtgaggcccgcttcgctccacaatgtcttgttgtagtagatgttgccggtgttgatcacggagtcgatgtacttgactttgccgttctcatcttcatgtacggatgcggtggagtagtcggattccaaagacttggtgtcgatatcgtaatccgctgcgtatggacgaatcaacgcatcgtaagagttgtggatgttgaaaacggccggaccgtttttgcctttcagagccaacggcagcttggtccaataatcatcccatgaaacattcaccgttttgatggtgacgttcggatacgtcttcgtgtaggactcaatcatcttgtagacaggatccgtgcccttgctgccccagctccagtactcgagctggattggcttgccgtcgttcacgagatgattggggtcgtaggtgatggtgttgccgataacgtcaagccctttgtcggctttcgtatcggttgtgccggacgcggcattgctgttcccgcacgcagccaagccgacgatgctcaaggccgccactgccactgcgatacctttgttgattttcatatctctccttacgtcctcgtaagccttcatccgccccttgcggacaagcaatagcatacgacaagggtttcatattggcaattcaaggttttttaaaatgtaaacggtttcatttgaaacccgtttcatctcaccgctgtgagcgtgcacacattgtttttcatacggcgtgtcgtatcgcaacccttttcattcatctttcaactctgtagccatgaggacggtaatgatggtaggctgaaacaaacagtgaaaaactttcggaggcaccatgaaagcgagcatcggcgatgtggcactgaaggcaggcgtatcgaacgctacagtctcacgcactttcgcacaccctgaacaggtgtcagaggcaacacggttgaaagtgcaggccgcagctgatgcgttgaatttcagcgtttccagatcggcaggaattcttaaatccggtagaacctatcgcatagcattattagtcggcagcggcgtcatcgaatggttcaccgccgaaatcattgccggacttaacgatgttttgcgtgacgccgggtacgatctggtcatctaccccatcgaggggtcggaggcgcgtgacgcattcttcgaggaacttcccgtacgcagcaacgacgatgccgtattcgtttcctcatttggcatcagccccgacgaggtcaaacgtctcggaaccgcaaaaattccgattatcggtatcaataccaccagcgaaggattcgatgcaactgtcggtatcaacgacaaagaaggcatcaaactcatcgttcgacatctcgccaagctgggacatcgtaacctgctgtatttatatgaaagcttttcctccacattgggattcagctcatttaaccgtatttccggattccaggaagcctgcgatgcaattgacggactgaccgcccgcacactggcagtgcaaaaaggcgacagcattctagatgcggcaatttccgagatcatggcgcaagacaacccacccaccgcattgtgttttcatcaggactcacaggcaattccattgttcttccgccttcaacgcagcggcctttccgtgcctggagatatttccgtaaccggatttgacgacagcaccttcgccaaagaagctgagctaaccaccgttcgacagcgcccatacgacatggccgtcgatgcggcacaaaaggctctggcgctcatcgaaggacaacccatcgaggaaccattcgagacattccccgtgcagttgcaagtacgcggatcaactgccaagccacgcgccatccctctgctgtaggccgcagcgtgtaatcgcacgaaatcgcttcgcgtaatattcccattccagcttggccgcatctgcgttatgtatggcagattttgcttcttgtccggagacatctcgcttatatatggcacgtcgcctgcgaaaacagccacttcaggggtacgtttttgaggttttcgccgcatgtgtctgccatatgtaagtgagatgtctccggtcaggcccccgaatctgccatacatagacgagatgcgagccgcagacaagcctcttcgtcttaccccggcgttcaatgtgcttttcttacggcgttcaatgtacttttcttcacacgcatgtacgtttaatcgcctcaagcaccgatgcgaatcaaactcaccaatgttcgcaccgtcaacggcatacgccaagacagcaacgcgacttaacccaaaccgccaacatcagtagtttggtagatactcgcgcgcatagccgtccacacctccattggacgagaggaaacgtggaatagagtcattgccttttgtcgaccatcatggcgacgcgcgcaaacagataacgctaaacttgtctcatgttgattatttgcttaacctagcgaagcgacgaagcaagagcaggtgatatatggtaacaatttctgacgtagcgcacgcagccggtgtttccaaggcaacagtctcgtatgtactatcgggagatcctcgaatcacccaagctacaacacttaaggtgcaacatgcgattgacgaattaggctatacggtgaaccatgcagcccgcgcactatccgtaagaaaaaccaaaacaataggtgtggtctcccccgcctttcacggcaactatctgtcagccctctttgggctgtacgtgtacctgctatccgaagaagcgacaaagagaggatacgacaccctactcattggcgagaacgacggcttcgaggcaatgcatgaagcatggtcgtcaaagaaagtggatgggttcatcctgatggacgtcaaagatgaggatccacgagtcagctatgcctcaaaagagcacattccgaccgttgcattcggctcgccaaagaactcacacggtttggatacagtggattccgatttcgccaaggctgcatcatcaatcttgaatttcttagcctctgaagggcataaagaggtgattcttattccatggtcacacacaatatttgatcagggtcttggctacgcttggcgctttctggattcagcgatagagaccgccaaacgtcttgacctgaaaatgcatgtcgaatatccgaaagacgacgattcggatccttcacccctcattgagcatgcactagacacgcacaccaaagcgaccgctctgatactgcacaacgagccagcaacaatcgttgcccctcaggtcttggcacgcaggaatctccgaacaccggatgacttgcaggtcgtaaccgttttcccgaaacagctagcaacatcaatgaagatatcgttctctgcagtgcgtccggacattacgcaactatcagaagccgccgtgggaacccttttgcgtcgaataaacaatccgaaagccccgacggtcacccgctatcttgattatccactaacccaagagcccgagtaacatcgcagctacgtagattacgcgcagaaaacaaccacgagattctacattggttaagttcgtcgatttgacttttcaaagatcagggtttattatttaacttgtttaaccggttcaacagtttgggattaaaacttcccaaacgcaataaattaatcattcggcgcataggtgcgctgttaatgaaaggaaataccaaatgatcggttcaaatatgaagcgcgtgatagctttaatcgccgcaagtgccgcggcagtcagtctcgccgcttgcggtagcaactcgagtcaagattccaaaacaatcgaattctgggacccatatcctcagaagaacgatagcagcacatgggcgaaatacgttaccaattgtgctcctgagggatataacgtaaaacgcatcggctatgcgcagtcagacctattaaacaatctcacaacagctgtcaaggccggcaacgcaccccagatcgccctgatcgataacccaaagatgcctaccgctgtcgacgcaggacttgttacggatatcgaggcagcgggagtcgacgtttcaggattcgacaagaatatcgaaggtcccggcatcatcgacggcgtacaatatggggtttcttacggcactaacgcattgggcttgtattacaaccccgatgtcctcaataaggccggcgtcgacccagaatcgattaccgattgggattcactcaacagtgccatcgaaaaagtagtaaacgcaggatataagggcatcacgttctccggcatttccggcgaagaaggaacattccagttccttccctggttctggggagccggcggtcaattgaaggacgcttcaggttccagtgccgagcaggatgcgcttgatctggtatccggctgggtccaaaaaggttgggctccgaaatcggtcgcaacggacaaccaatctgctgcatgggatctgttccttggcggcgattacggcttctccgaaaatggttcatggcagatggagtcggccgtcgagaaaggctacaagatgatttccatcccatccaaagatggcggagtagccccagttccaagcggtggcgagttcattaccattccaacccagaaaaccaaagacagtgacaagatgaaggcaaccgcggaggtcattcagtgcctcattgacggagataatctcaagaagaccaatgatgagatggtttatcttgccgccaaaagtgacgtccgcaagcagcaggtggaagagaacagtgcctgggcaccttgggttgacgccgtagaaaatgctgaaggccgtaccactgacgttggtctggaatacgaagacatttctgcacagctttctgaagatctacaggctgccttgaataagggctgattcgcggtctcatatttttccggggcatctgcccgccattcattgcgatattcagacgccccattccatcttttccatcaacaggcaggtgaactatgtctcaaacaatcaccgcagataaaccaaggcgaatcaagccaaccacattggccgccattggtttcgcggccccgctgattatttacatgcttatcttctacgtttggcctctgattcagaatatttccatgagtatgcaccgctacacacgtcgcacttttgtgaccggcgatgccccttggtctggattcgatatctataaggaaatattaagcaatcaacagttctggaccattctcggacagactttgattttcgtcttcgcttctatcgttttccaatactctatcggcttggcattggcggttttcttcaatcagaatttcaaactttccgcggctttgcgcggcgcattccttgtaccatggctacttccgccaatgatttccggtacgatctggcaatggatgatggacgccgacagcggtgttattaataatttcctcaaactatttggtttggacccggtttggtggctgcaagccgatcattccttgtgggcggttatcattgccaatatttggcttggtattcctttcaacctcgtaattctgtattcgggcttgcaaaacatcaatggcgacttgtatgaagccgccgcgttggatggctgcaatgcttggcagcgcttctggaagattactttcccgttgctcaagccggtatcgatgatcacgctcctgctaggtttcgtctacacgttacgaacagtagacatcatctggattatgaccaagggcactggatcttcgagaaccttggcaacttgggcttatgagatggctttcggaaagggcacatcagcaaccatccggtattcggaagcatccgttgtgggcacgattctcattgtcgtagcactgattttcgctctgatttacctgtgggcccagcggaatgaagagaagaggtaactaaaatgaaacatcgttcatcatggtggaaaacacttataggcatcattttgacgctgattatgctcttccccgtatactggatgatcaacatatcattcacgcaacgtcgctccatccgttcaggtgacctgtttccaaaagatttcacgctcgacaattatgcctctgcgttaagtcacagctcccctacctaggaacgtcattgctggttgccataggatgcgtgatcctgactctagcaattgcattaccttcgtcatacgccattgttttcttggagttcaaaggctcaaagtccatgaacttcctgttgattgttgctcagatgattcccgcggtcgttatgtctctaggcttctaccagatctacgatgacatcggccttctcgacagtattccgggacttatcgttgccgactccactttgtcggtaccgttcgcagtgattctgatgacgggatttatgtccggtatgccacgctcgttggtggaggcagcgcaaatcgacggagcatcgcagtggggtgtttttaccaaaatcgtgattccactctcccgtaataccattgtcacgacttcgctgttcgctttcctctgggcatggtcagatttcatgtttgcttcgaccctcgattccggtggcggcaagatgaggccaatcaccatgggtctatatgactttatcggttcacagaaccaagaatgggggccaatgatggccaccgcagtattggcctcagtaccaacagcgctattactaattttcgcacagaaatacgttgccgccggcgtaacagccggagcggtgaaagactgatccaacccttaagtacataattaacaaggaccaactatgagtgaactaacttttgctatcgatggagatgcactgttgtggactggggacggcgaataccttcgcatcgaaccatggggaaagaattcagtccgcgtccgcgcctcgaaaatgcatgagatacaggaacaagaaggagctttgctaccacaaaacaatcaggtctcagacagccacaactatggtatcaccattgacaagcccaatagaaccgccgaattacgcaatggcgatattgtagttcaagcgaaagcatcctgcggcctgtactccggatcaggatatgaagagccacgctgtttactgagcttctataaggcagacggcacaccgctcattcaggaaataccatctggcggatcactaaatcttcgagcgcgatggttcaaaccgatcaccggaggcgactattccatcgttgcttcctttaccacaccggaaaatgagaaactatatggtatgggcgagtaccaacagaacatcctcaatctgaaaggttgtaccctcgaactcgcgcatcgcaattcacaggcatctattcctttcgtggtttccagcgccggatatggcttcctgtggaataatccggcacttggaaacgttacgttcggcaagaaccgtacggaatggcgagctgaatcagccaagcagattgactactggattaccacaggcgatacaccttcttcgataatgaagcattacgccgacgccacagggcacgctcctcacatgcctgaatggggactgggattctggcagtgcaagcttagatattggaatcaacgtcagctcctagacgtcgcccatgggtttaaacagcgtaatattccattggatctcatcgttgtagatttcttccactggccgcatatgggtgacttccgttttgagaatgaattctggccagatcccaaagctatggcggacgagctgcacagcatgggagtgaaactcatggtatctgtgtggccccaggtcgcgctcgcctcagagaattatgttgagatgaagtcaaagaactttctcgtgcgcgcagataagggtgaagacgtcggcatgatgttcgaaggtcccagccagttctatgacgccaccaatccaaaagctcgcgaatatgtttgggagaagtgccggacaaattatgccgagcttggggttgatgcattctggctcgatgaagcggaacctgaatacggaacgtacgatttcgacaactatcgatattacgccggtccaaaccagcaggtggcaaacatctacccaagagactataacaaaggattctacgaggggcaacaaaccataggaagggatggtgacatcgtcaacctcacccgttgcgcttgggctggttcgcaacgctatggttctcttgtttggtctggagacgttggttcgaccttcgccgaccttcgtgcccagattacctgcgccatccacatgggcatggccggtatcccctggttcaccaccgatatgggcggtttccatgatgggataattgattcggacgatttcaaggagttgttggcccgctggtgcgcgttctcatgcttcctaccggtcatgcgcaaccatggcgaccgtagtctgcatacggcaaccggcaaggagaccatcaccaattcggccggagaccaccgttcgccaagtggtgccgacaatgagccttggagttatggccccgagacggagcagatcttccgaaagttcattgccattcgcgagaaaatgcgcccttacactcgggaattgttcgaatcagcacataccgatggccagcctttggtccgtggactcttctacgagttccctcaagacgaatcggtgtctgatatcgccgatgaatacatgttcggccctgatatcctagtggcccccgtagttgaggccggagccagatcgcgtgaggtgacgcttcccggaaacgctagcatcacatggacggatctacgcactggcaaagtgtatggaggtgggcagaaaatcactgtcgacgccggaatagacacgattccagccttcgcgcgcgacggccatgatcacgggctgatcggaatgctataaattcccgcacaacaagtgtggggcgtccgttcccaaggcgaacgccccacactctgcgcatctttcccatttcaaccggtctatctgcggtatgtatggcagatttgtagcgggctttcagtcgaacagatgttgagcagttttacatggcacttatcaaagattttgttttctgccgctccgtacttaaggaattcagccagaaaataccgatcgcttttgcagccgcatcaattaagtgactgcaaaaatccattcaatacgttgctgccagcaacacctcggaaagcaaagtcaaaatttgaccaacatattcggaggcatcgccaagcaatgcaaccgtattaaaacttggttcgattaaggttcgataaatctgcctcgccatttctgcttatgacgaagcaaaatacatccttcccacatggctttgctgctttttgtatcttttgttgttatccgttgccacttgtcggcatcggcacggcatgtcagtatcatgtgcgtatgcgacttattggtaatattctgtggctgattctgggtgggttgttgctcgccgccagctgggccattatcggtttggtgttgtgcatcaccattgtgggcattccactgggtattcaggcgttcaagatggcgggactcacgctgaccccgttcggtaagaccgtggagtatggcggcggcgtgggatccgtgctgatcaacatcatctggttcgtactggccggtttgtggatggcgattggctacatacttgccggcctgctgaactgcgtcaccatcatcggtattccgttcggtatccagtcgttcaagatggccaagctggccttgtggccgttcggttcgcaaattcgcagcttgtaaattacttcagatcacttcacccagcatagacggccatcgactgccgtcttgcatataagtatcgaggagctgcggtccgaacaggccgcgaccactgcgtcctaagcaacgaaacatatttcattcgcatatggcagctccagagcggcaaggctcaaaaacctgaacagtcgaacattacctccccaaatgattgctgatgccaaccgcgaatcccaccgcagcacttccattcatgcccaggtcattcaacaatcgtcccgcgtgctgcgcgccggcccataccgcgttgatgatgttgccggcgccatatccggtaagcaccgtccacggatgggcgagcagcccgcatatcgggtcaagactctggtagattcgcgcgaagaacgatccgggtgccggcctgcattagcacagcgccaatcgcatacacaacgatgaggttgcgcaaccgcttggcatagcccacgcataagccacataagcggcagcaatacgccgaacagatgcatgccgatatagctgggctccgcgaacagaaactgcgggcgaccaccgccccacaccgagctttcattgatgtactgccggtacatgaggtgcgcgaaatagtcggtcaacggcttgatatgcagatggatggatagccattgcaccacgcccacgccgaaggagaaccagtaagaagcgatgagaatccgcaatggcgtacgccatggaatgcgtttgatgccgaatgaaccgtcggcaagcgggcaactgatccgataacgccaacagcacaccaccaatattttgtctcgtcattccgactcgagggattgccaattatctggaggaagatctagtttgagatattcatacgaattcattttgatttcagaaagaacgcctttggcgttgcgaatccagttgttacccttattgtctcgaaaggcaataaccgattcaacacgaacatgcattccttcgcccggataaggaacataagtcgtaaatctcccaggaggaacggtacctacacaaacagtattatttgtcccgctcaaataatcggcaccagccccttgatatgttccagaagttaaaacgacatcatagatcggctgatccgaaccattattgacggaaaccttcattaatggagaattctccaccatctgaacgccgcctttcgaatcatgtaccacccaagacgatatctcattcgcttgttcaaatttggcaatctgctggtcatgattcttcacatagtcatatgacataaaagcaataacgatggaaatcacggaaataccaactgtaaatatgtctgaaacattggtaagccccggatgttcggtattcaaaaaagttccaatggctttaatcattccaccaacctcttgccgaatatagttcatacattaatctcttccccgccgagacaatatccccattctccgactcacacctatctaatcctcaacggcagcataccacacactcaaacatttgttcgattttatcttttcgtaaaatatcccagtcggtctgggtacgtaggattcgggggagggaagagagaccacagactagaggagaattgtgagcgagaagaaccagaccacggagaacaacggcggtatgagcgccaaacacagcgcaccggcgcattcccgaatcgcaaatggggaggggcggaactccagtatcgagctgttgcgcatcatcgcgatgttcatgattctcgcccatcacttcatcgtccataacggctacgacgtgctgaaactccccctgaaaccggaacggatcttcttccagcttgccatggccggctgcggcaaggtcggcgtggtcatcttcttctccatctccgcatggttcttcctcgacaaggaacagaccatcaaatccaacctgaaacgcgtgtggatcatggaacgcgagctcctgttctgaagtcttatcctcgtaacgttctacctcgtgttcgaccgagccgatctcagtatgaaactcatggtgaaaagcgtcatgccgttgagcatgggcgtatggtggtacgccaccgcctacgccatatttctggcgctcctccccttcctggccaagggattgaaggcacccggccgcgaatgccacttctcgctggccgcgaccgtactggtcatatggggattgaccagcttcatccccggaatgataaaaattaatgatggtttcttcggattcatctacctattcagcctaatctccgcctacaagtggtatatagaaccgttcaccaccagacaggtctggctgacgaccggcatcggactcggttttttcctgttgtacacctgcgcctccataacattgtcgctgctcgggcacgacatgggaatatacatcaccggcgcttggaagctacccgtcgtcatggtgggtttcggcatgttcctgctgttcgaccgcgtcaccttccacaaccgcttcatcaaccgaatcgcgcaatccgcgttcgccatatacctcatcaccgattacaccgcatccgagaaactgctctggatcaagttgttcaatctgcagaacctgtaccagcagccattggcaatcctgcaaatcctcggcatactgctcacgatttacgcggtctgtatcctgattgatttcgctcgtcaagcactattcgcctttactatcgaccggcgacgcaggcactggttcgacctgctgtggaaacgaagcatctcatttaaggcataatcgtaatcacacttttgataataaacaatacaggggtcttgacccctcttctgtcaagacccctactcacatcgatgatagcgaaatgctgattgtccagccgagacaaaacgaaggtagtgcccgaatgtatgcgagggtatccgctcgcagacgttgagcaacaagttcaagaaagtctacggggaaatagaagaaagggcgcgggcactaccaacgtccgcaccagacaacctcgtgataggaggctgcagacgttttctgggaaatagccatgcagcctcagcaccagtttgttatctttacagatgcagattcatttcggccaccagtattggagtgacagaattccttgaaagcgataatcaaagctttttgatgatgcgcctgagcttattaatgacacgtctgacgaggttcatcatacgctttttgaaggggatgctaacgcgccagtacttacgttcaaggggtttcatatgcttgttgaacacggcgaaatccccggctttgacggcctcatggaacgctacaaaactttcatttttcaatgtggtgcgcattgcgtaaacccgctgacgtcgttcaggaataccatcaagggacggcttaatacgtttggtaggcgtccattcgccgcgctgttggtggatgtacagacgctcagctaaaccttggcggcgatggcggaatccgctggactgtgattgatagacttccgtcgcatccgaatcatgcaggacaagctcattcctataccggttaaacaaatcctgaatggcttgattccggataatgataacattacaacctttgtcatccgacacatatttaggaatccatgcatctccgaaagtcgcgtcagcggtctcggcaagcacatcatcgcagtaatcacacgcattgtatttgaaatagccaagcccccagttcgcggtagacaattcagcaatgcgcttgacaataggttcatccttatccgtacgacgtacctcaattgcataatccgaggcacgtgtgccgggagtcttgtgtcggaagtccacacgtgcaatcttgtcaaggggcacgcccgattcccacgcttcggcttggccaaagaaatcagatttcaaatgtccgcatatcaagccgatgcaatagggaatgcgcttcattagcacaggatcttcacgacgtaaaagccgtacggccttgacaaagcacggaaggccgataaacaagtaacgcccttcgtgctcacgtacctgtttaatggcctcgctgagttcaataggataatacttcgcttttgcacccgctttaatctcatcaacagtacgggaaatctggatagtgtacatattcttaggatcaggaccatccttggcgtgaatgaccgcatctacaagcccgtcctgaagcattttagcagccagccaactgatcatgccaccggaagtaccccgggaacgccaaccgtcgacagccacgtatccggcataagcactcaggtaataacctagatgctggtcatacttaacgccagactgtttgctaaacagctcctccccgagctggttttcgtctaccgaggacgcgaatgggcaaacacgctccgccgcagtccaatcacgaggctcgccgacaacactggctcgatagcaaccatctgcattttttgcaatgcgaaatgccggatctattactgcacatgaaccgcatcctacgcagtatgtggccgcgcctccaattgcatccgcgtcaggagacgatatcacacgttcgatagtatggagctcatcatttttgactccggtcatttgttaacctttctcttcgacatgccaatcacgcaaaaaaataagtagtagatagtacttaattatcacaattctggagatgaactgttatgaagcatagaaatgaaccttgtactgtatttcaaaatacactatttgacgatagtaagaatatcctgaacaggatatcgtttagaaatacatgtatgtgtttcatcaggaaaatgtccggccgcaatatacataatcaaaaactcattttcaggaactccgattatattgcgtgtctgttgatcaatctgttttgagaacatggtgtttagaggacatgcagcgattttattagcctccatagccatgagtaaggccatggagaaaagaccaccgtcaacaaaaccttcattgtgttcacttatcgaaagaaaagcttcattgtcagctgtaatcaagaacaaagccgggggaaccttatacccattaaagcctccttgcagcttcaacgctttctcaattatagatttatttgtaatcgcgtacacgcgaaccggctgacggttacagaccgacggcgctttcgtagccacttcaaccacatgttgaatctcggtttcagtgagaggactatcagaaaattcacgtactgatctacggtttaggaacaggttctcaaagggaatggttgcattcccatctttcaatatggctttaaccgggacacttccaccattaacagaagttgatgcagaagcgtcattccaaatgtccgaggggaaaagcgcaatcatatcatctatttgataaccagcattttcatgcctgtagcggtattcttgtaatgccgatacagcactctgataagccgcacattcagggtagttagaatcacatcgcttcaaatcttttaaggctgaggaaagattcattaaagctgactttccaaatccatagcggaaatcactatggcttaatcctttttcgatttgatgactgtagaacgttaccttggcgatgtaatgatttacatttttattgccatcattcgtaatggcattatagaaacgtttcagttgatcaaacgactcacgctttaaacgcagccattgttttctctccaataaaaaatttggagttatttttttaactttatctttaatattcatctgagtatcctttcccttcaattaagaatatatgcccatattatcatcaaactgaaattcacaccctcagcattcgttaatcatgctataacaaggaagcgagacagctattaattgggaatatattcataaaatatgctttactaatccatgtattattttctcttaaaaatcgaacgaaccctgtcaacaacaatatgaatatttgatcgttcaaagagaacatggaacagcgtcaccaacagaaccgccaacacaagattgcagaaagcataacccacccaagtcatcaaagtgttcggacggaacggaaggcagagccatgaagcggcacatattagaataatgaccaccagcgtctccaccattcgccgtaatgaaggaagaatcggaagatgcgtaacattcttcggaatgaagaaaagcaaatcaacacatctatagaaattagacaagcaagaggcaaccagaacacccgtaagaccaaatgaatagccgaggataacaccgccaacaaccagaatactcgcctgaatggtgctctgaatccgtgtttccttgtagagaccagctgcaatcactagcattccttgaggtgtttttaaattataaagaaccccattgaggacgaacagcacagcaaaaacaatattcacgtactgaacatcattaacaccttttgtatacacctgaataaatggaagaattgttgccatcgtaacaccgtatactatgctcatcgccatataatataggtattcaaagtctttatatgctttatcgaacgctttcatgtcttttttcactaagagttctccgaagccagcagatactccagtagaaaacaccgacattacaccattgattccagcgagcaccatattatagacagaataaacactgaccatcttcagtgtagagaataacgtagtcaatacagcaggagaagcattttggacagtctgcacaacctgcaggtacaatgcactccaacgcttatccatggcggagttatctggtactactttataatcaataaacttatagtgtatctttatatagagatataagattaaacttctagcaaatatggaaattagggcgacgattcgaaggagcaatatgtcgactctcaaagtcgatagaacaacaacaatgagagtattaaggattgtataaacaattgatgctgtggagattacataagttttttgatccgccgtcaataaagctctatattttgccagagtgaaaaattcgagagctccatttactccgagtacaaggaccagacaaaaaaccgttcctttgtccagtacctctgtatgcgttatccaagggtacacaaaggcaagcagaaaaacaaggccgacaaagataaagccagacttgacatagaaattccgcgcagcaacaacaacacgattgatctggttataatcgtgctcagctattggtttatataatgaataaacagcagcacttgacagcccggcctctacaagattaaagtaaacaatgaactgattaatggatgaaataagaccattaatatctgacccataagcgactaacaggaaacggggtgtaataaaccctgctaccatagttactacttgaagaagcgcagtcgataccgcattgagaacaaatttgcttgttcttcccaaaacgctcaccccttacttaagcttaaccccaacaaaagttgcaaacgcgtagatgatatccttgtaactcacacaacgcatgcggcataacgaataaatggagtccgcagcttttcttctatcaatatgttcgttggcaattctcagataaatgccttgaaaatgctgcctgaccaaagtgctcatttcagctttatcgtcttgtatacatatatgatctatcagtctcaacaaaagacgttcttgtctctcaaaacgttccaactgagcttgttcatcatgctgtttagaatttgaatgactagtaggatgcagaatatatgtgtatagaactttattaatataagcgtaattatatctatacgctataggaagaagaagctgataattttgtccagcgcggctctcatcaatatgtaagttaggataacactttttaaaagtggaagttctgataatatagatacctggacagaactgtacgttattactgacaagtaaatcacggaacaaatcatcattttccacaggtattctttttagaatgcctaaatcactgccgttctcatccacatgttttgcccatgcgataccaagatcaatactcggattctcttccataaaatcaactttggctgacaggttatcggagcataaagtatcatctgaatcgggccagataaagtacttgcctttcatatatgggaaaccagtattaagggcagcagcctgtccgccattttcttttgcaagataaacgaatcgatgtcccttttcttcaaaactttttttgtatcgtagcgcaatttgcgctgtatcatcagttgaaccatcgtttatgaagatcaattcatagttggagtaatcctgattcaatacagattcaaagaaagaaacaagatacctagaggcgttaaaagctggggtaataatactaacaagtggttccatttttctgcaacgctttcttattgaaagtctgatatatagctatacaaatgccgagcaccacaaattgacacgaatagtagatggtattgccggttaagctgtatacggctataagaatgatccaatatactgcagtaagaagaatgacaggttccaggccttgcatatctttccaacttaaaaaactgcgaattagaccataaacaagtgcggaaagcaagacaacgaataacaaaaggccagcaataccaagctcagcaagaagctgtagataaacgttatgggcttgatagctccaaagcaacccataataacggaagccttgagcatttatgtaagcattaaatgaaaggaatcctctaccgataagtggagatgcttcaaacatctgcatggcatatgtccaaataacctgtctaccgctcaagggatcgccgttatctgcaaacaacctgtcaagcactagagatacttgaggaataagcgaatcagctattgtcaatgacgcaacgagtacaaaggatagaccaagagcaattgaaattttgtgcttcttggagaagaataatgcaaatacgataagccccattacgggaataagaaacaaagttcttttacccgtcatcattaatgcagcaaagacaccaacgatttggaacaatctagttagggtaaagcctctgacaaaaagctttgcaaaaagcacacctagtcccatgttgcatagaaacgctgcataacctttttcataagctagtcccgaaatagcaccaccagtgttaactgaaaccgcagatcgactacttccaagatcgagaaaaccgaaaagtgaggcaaacaaattaggagccaatagctctagatacatcgaaaagataaatatccagaacagaaactcgaactgcttaatgagacaactaaaaaaggtgctatcaaatttaaaaagcgtcaaagaaaagacagcaaggacgtaaggaaaatacttagtataagttaagcgatcatctgtgtagagaaaacttatgcagataagtaagaaaaaaaccgtataaattttctctacgacagaagataaactacactttcttttcgacatcaacacaaaacagaagatagcaactgtaagaacattagctaattgtctcgtgataaatatcagtttattatcagtagaaaaaactaatataagtaatatgcttggaataaagtaattttcaattggagttgttctcagccatattcttaacttatatatcagactattcattggaacaaattccccggagataatctaaggcagactccctctcgctagaaagtacggactgcgcatgctcaaaatcacgaacgatgtcaagattacaatcatccaaagtctcaataatcgaatctgtgagaccagtcagcttaagtaaattctctgctctatcgttcttcttgaaatctttctgtttcgtctccacatatagcttgcgattgaagattacagaaaatgccgtaccatggaaagaattagtcacaacgtaatcggcatgcttgaatagaccaaggaattcttcaacggaagtgctgagatcacctccaaaatccggatttttgactttatcaatcaaatcctgaccaatattgataactttcttccctgtcttctttgccaactctctggcaaaattatcaataatatttgatttattcaagcgataaataagaatgtaattatcaataccgggatctttcgcgagcttcgaccattcagcagcatccaaaaggaaaaccgggtcaacatgtaatgcgcaatcttttcctgtcaattcacgaacgatacggcgcccagattcctctcggaccgagagatgattaaatctattaagcaacctcgtgtattcactcttgtactcttgaggaatttcactaattccgaaagatgctgcataagaatttattttcctcggatcttttacaaacgaaagaaaataattcttatcgaaatctgaacaagcgtagttaaagacttgatcacttccggtgatgaatacatcatagcgttgatttgctgtagtgatggactgtgaatcatacgcaacaggacttaatttagtatgactggcaatcatagagcggaaactattcatcttcttccaagacggaataagattaataaaccctctgatattctgcttaaatgttttctgcttgaaaccgccaatcaatttatacagattttccatatgctcacaccggtaatcaattacctcggtatcaaagccaaggtcagatatagccctctgcagtgcgtaagtctgcagtgcagcaccgtagttgatagcgcggtgaaacgtgatgacaccaattttcattttaaataccctttcagctggaaacataaaaataggaaagatagaacaatatattttttcttcataaatgttttatatataagcttatccaaggaagaattcggcttgaataaagctaaacaattacgcagattctgatttgagacaaccgctctgaaaaacggcaaacgacctttatccaacggtgcgctgcgtaaagcaaaacggaacgaagcaaacagcctcgatgcgtttcttgatgagaaacaaaatccatcgagcgtttccgaaaattcgcactcaatcattctatacattgagacaagcttgtcaataacatgtacatcaacacattttgaatacgaagattcgcttatatggtattcataataactattcggaaggaaagatactatattggacgattccagtgctcttagcttgaatacaagatcttcggaataaacagttctttccgaagggaattcgataccattttttcttagcagggatagtctaaatatgccatcccagaccgcgacacaacgcgaaccaacatcccccgtagaagaagctataagatcggccatgtgttgtcgaatagcaacatcgccttggagtacttctcgcatgtttggatgttcttctaccacttccccgtctttaatatctctataccccgagaaaacgagatctgcgtcgaattctttagctgaaccaatcaatgccctgtacatctcaacattgcacgtatcatcagcatcaacaaaagctatgtattcccctgttgcatgcgacatgccaaaatttcgagcaatgccttgtccagcattttcttttgtataaacggaaatccggtcatcttcctcggataaactgcgacaaatagctaaagaatcatctgtagatccatcatcaactacaattatttccaaatcagttaacgattgatccatgaccgacagaacgcactcttcgattgtcgacgaggcgttataacagggtatgacaactgaaaggatgggcatatcattaatctcctatgccttccaacattccataaaatgttttttctccatcatgctcgacaggaaaatcttgtttccatgtaagcttgaacaaatcagtatgagctgagagtcttttccacatatcctcgtcataaggctggtcaagaattttaaatagctcatcacagtccggattatttggctgaatttcattaaaagcttcggcaatccatggatcgtgacgctgagcgagaacagtcaagtagtccaccaaaagataatcgaccataaaatcatttcttcgccaatattcaaggaaaaaatctcgaatcgtagcgaacgcgcgtctatgatcgtcatcacaacccagcgaatagcctgcaaacatgccgccggcaacagaagcatgcagataatctggcctcttaatcgagaaaatcggaccattgtataggcttttgtcaagcgaaccaacgcaatagaaggtggaatcaagccacattccaccatatgaagccagcaagctcaatctcagcaaatccgaaagatttgttctagtaattatccctgcatctatctttttgataatccacgaagggaattttacatagtttgagacgttcttatccgtaataataattacctcacgtcccccagcattacgtcgaaccgattccacacatgcctttacaatttcaggagcggaatccagtccctgccaccagcacatccaaatcttattgctcctatcagaggcaatagggggtaggggcgcatcatagtcataggaggcgtaataatcgccaaaacgactctccaaatatcgcagtacggcttcatgcttacgcaacagacgagctttaactgcatccgattcttggtatccgttatggttcatcacttgaatgtcaagcttcgcacggaatgcatttattccctcactgaaagaggtttctttcgctatcattcgtgaagcatgtatttcttcagacgcacggtgaacaatgcgctccaaactattatgcctattcgccacgtgcaatcctcctgtaagaatcttcaagttgtcgaacgtattgtgattgttcacaacgctcattcacgtatttggtgcaggcttgttgcatgatttgataatcattcccgcccgcgtgcgaggccttaataagagcgttagttaaatcacttacattcccggattcgaaggcgaacccagtttcaccttcaaccaccaactcggggataccgccaatccgagctccgattactggagttttagcggcgagtgattccaagccggaatagggcatgttttcacgccattcggagctcagcacgctaaacctggcgttaccaacctcgcgctgcaaatcctcaccagacttgtagcccaaaagctgaatacgtgaagcagcctcggatcctgcattggcgacaagacgctctatctcgggacgctctggtccatcgccaacaatgtggagattccaatttgaaggaaggatagttttatcgttcgcagcttcagaactttcagccgcgtggcacacagcaccgtcactttcaacggaatcataaggagccgtcagcccagtagccttcaaaaaggctcgaaccagcgtcaagattcctttttctttggaaagtcgcccgaagaacaggaaatatggtcgttttccgtcaacagcatcctcgaatttatgcgtattcgcaaccttacgagccatttccatctgtgaatcggtcaggaaattctgtaaagcaaccactttgccagcaaaaccgccttcttcaagcttgcttttcatgaactcagacggagcaataatcaaatcgatcttgtcgtaactgtggtgcagtttcaggaactctgcttccatggtcgccaaagcacttttgacacgggaacctttcacacacacgttcttcgtagcatgtatgaaatgcttgtccaagcaggcatcacacacttctcccctgccattcaccatcgtataggccgggcacagcaaaatgtagtcatgcgccgtatacaccaccggcacatgatgtttcttcaaatacggtgcatcaagaatcgagagcgtcagctggcgatgcacattgttcatgtggatcacatctggcttgaattcctccagcaaagcttcgaacttgcgtctcgcttcaaaagagtaaatcagtgtggaagcttcctgaactttcttgaaagcggaaatatcccccacataatccttttcggaaacaaaatatttattccaataacttgactcgttattcggatgctgcatggaaaagaatgcaacctcatgaccgagcgcgcgtaatccttcagctaacgcgaagaaataggtttccgcaccacctttacgatagaaatatttgttcactaggagaattcgcatgctcactctcccccatacaggttcagtgtctgatcggtgacgtcatcccagttatatttaccaacgatgtaatctgcggcatttgccttgtaacgttgtacaagatcatcgttttcgagcaattcctgaagtttttcccgcagggattcaacagaaccatgctggaatgtcgctgcgtgcccttctactacttccacacattccggaatgtcggacgtaaggcaacagttaccgtaactcatggcttccagcagactcatcggcatgccctccaagtcgcttgggagcacataaatataagcattgctatagagctctttgagcgcctgcccttgtatgaatccggtcaaaataacacgagaatcctgattagccatctgctgaatatgctggtaatactcgttggagtcggaagcgcctccagcgatgacaagctttttgttcgtattcagcttgctgaacgcctcgataagataatgcacgcctttctcgggaacaatacgcccgagaaacagtacatagtcgttcttgtgaagaccatatttttcggtaatttcctgcgccgaaaccggctcaccatattcaatgccattgggaatgaaatgtgtaccgcgaccatatttttcttgaaaatactgccgcatgctttcgctgagcactatgatttcatccgcgtatttcgctgcggtacgttctccgaacttgagatatgcggaggcgaacttgccccatttggcacgctgccagtcaagaccgtgaatggtcgctaccgtgcgaatgcccgcccaatgcgccagacgcagcatgacgcagggaccttcggcatgatagtggatcacgtcaggcctggccgcaatggctttcagcgtcgcaaagaatgaggaggtcaacgccgccaaacctttcgcttcgaaagttggcactggaacaacacgcacgccgttatatacaaagggcttatttgcagaatgaacgtttccgtcaaattcggcgcccgcaacattatgtcccttgcgattgtacgcgatgaccttatgcccctttgcggccatacgcgtagctagttcatctacaacgatctcaatgccgccttcacgcgaaggaatgcgcttatgacctatcatcgcgatattaaccatcaccggtcaccccttagttattcagagtgccggaatcgtgccacaagcgctatgcatggcagaggattgcacagtctgaccactaaccaaaccgacgtaacggccgttatcggctctttttgcaatcgatcgacctgtggtcggcatgcgagtcccgtcctttccctctaaatgaaccccgaattggtgtctctcaagagcaacccaaaccgcgcaggagttacccgatcccgttcatcacctgccaaggtcgatttttgcatccccctcagacacacccagcccccgtcacctactttgggggtattcttcacaggttttccatgaacgctttgcttgctcgtgacttaaaaactgtgtttgaaatctgattcagtcggttttccggacgtttctgaatgagaaaaagagccgataacggccgttatgtcggcttagtcccggttcgaggacggtaatccagtgccgattcgcgtagcccaggtcatgggaaaaatgcttggcggtggtgtcgaatccgtagtgatgaactactaccgccatatcgaccgtagcaaagtgcagttcgattttttggtggatgccgattcgactcgcgttccagaagaggaaatcaaagcgttgggcggccgcgtttttcgcatccctccataccagcatccccttcgctaccgcaaggaattggtcaggcttttccatgaggaacactggccgatcgtgcacagccacatcaatacgctcagcgtattcccattgtctgcggccaaaaaggctggagtgccggtccgtatcgcccactcgcattccacgatgggcaagggcgagtttgccaagaacctgatgaagcttgcactgcgtccgctctcgaacctttaccctacagaatgtttcgcatgcagtgaatacgccggaaaatggctgttcggcagagacgctgacttcacagtgattcccaacgccatcgaactggagaagttccatttcgacccagtccttcgccaggaaacccgcaaggaactcggcatagccgatggtatgttcctgattggccatgtgggtcgtttcatgccgcagaagaatcaggctttccttgtcgacgttctcgccgagctccttccccagaagccggacacgatgctcgcgttcgttggtgacggcccagacaggtcagacgtgcagcagcacgcccaagaactcggcattagtgaccacattctgttcttgggccaacgcacggacgtcaaccacctttaccaggcattcgacgttttctgtctgccgagccgttatgaaggtctcggtatggtcgccatcgaagcccaggtcgccggatgcccctgtgtcctcagcgatcaggttccgcacgaagctgatatttctgaaaaaacatctttcataagtttggaaaacaggtcttcttggactttaactctactcaacatttcctcgcaaataacgaataggcaaatcaaaacatcaaatgcgcgcgctgaaaaatatgacatttcagctagcgcgaatcgtctgacttccttgtacgtaagcagtgcgaaaagtgcgaatggatgggaggaggcattgtgaatcctcgcgttgccgtaatcacttcaggttatctaccagtgccgaatgttctcggcggagctgtcgaagcgttggacatgatgatggttcgggagaatgagaagaccccgaattttgatttcactgttttttcttcttggacacccggcgtagatcaggtagcgcgtgaaggcaatttcaagcatgctgatttctgctttatcaagacgccattgctggtccgcgcggcggatcgttgcatttattgggcagccaagcatgtgcttcacaagaagaagctcatgagctatcggtatatcgcgcaacgcctgtggtatatcaacaaggtttccaagaagctcgcacagcctacaaagaatggcgagccggccttcgacaaagtaatgatcgaaaaccatgccacattgttcatgaccatgcagaagcacggtaattccgagcgatatgcgggaaaagtgtattaccacctgcataacgaagttcttaatgatttcggctgcattaaagagatttccaaagtcaaaaaagtacttggagtttccaaatatattgttggcacgcttgacacgtatttaagagagcatggcgagcctggtctgcgcgaagatcagaaagctgtatggcgtaatggcgtcgacacaagccggtttggttcgaaggaggctaatagcaaggcgattgaatttcgaaagaaattcaatatagccgagaatgatattgttttcctgttttccgggcgtcttactccggaaaaaggcgctgaagaactattgaaagcgtttactgaagtagcgcagaaagttcccaataccaagctggttattgccggagctttcttctttaattcgaatatcgtgagtccatttgaacagaaacttcgcgatttagcttcaaatcctgttgtgaaagatcgaatcatcttcactggctttgtgaattacgaagatatgccagctatttatgccatggccgatatatgcgtattgccgtcaatttgggacgatccagcacccctcgcggtaatcgaaagcttggtttctggtaagccgctcatcaccactcgttccggaggcatccccgaatacgccgatgggcagtcagccatcatccttgagcgtgatggaaaactccaaaaacaattggtaagagcgatgattgaacttgcagaaaatatagaagattttaaatcaataatggataataattcattgaggacacaactcagtaaagaagaatacaatgcgcaactatttaatcaaatcaccaatacgacagcttcatctttgaaagattaagtttttctgccgtacagttagttattcattggttatattgagcgtattttgttatccattcccgttattgctgatatttttcaggttataccaatgttaactatgtcaaaaaactcctggataatacattttatttttgtttcttttattttagcagccatgactggattgatattgaggttcgcattcagctatgttcctttttgtattacataagcactgtttattttatatatgtaaaggtaaataaaaacaatgtttttaaaaagttattgtctgtcttaccaaggtattttatggttgcaggtttaagagaggagtgagattcgagaatgacacagaataaaacgcaagcccgtatttttaaaaatgcgttgttcctatacgcgctcacgttttcgaactatctgattggactgttgctcctgccgtacctgtcgcgcgtgctcagtgtggagaagttcggcgtgatcggattcgcgacgtcgttctgcctggtgttccagatggtggtggagtacggcttccagctgtcgaccaccgcgaccatctccgtgcatcgcgatgacaaggcaaaaatgtcccgaatcatctcgacaatgacgtacaccaagctgctactggcatgtggtgcatcggccgtgttcctggcatgcgcgatgttcgtggacatgctccgcggccatttcgtgatcatactgctgttcttcgtggactcgatcgccaaagcactgcttccggacgcctacttcagaggcatcgaacgcatgaaggacattaccatccgcgcggtgtccgcaaaatccggaatcctggtggcgacgctgttgttcgtgaagggcgacgacaccctgatcatctatcccgtctcgatgatcgtattcgataccatcgcgctcctgtgggcgttctccctgctcaaacgcgacggtttgaaggcgaccggcaccaccatgagggaaatgctggaagcgttgaaagacagcttctggttcttcatatcccgcatatccgtgagcatcaacggatcattgggatccatcttccttggcatgcgctacagccccgaatccgtggagatgggcctgtactccggcgcgaccaagctgtcgtccgccggagagcagatgattccgccgctcggcgacgcactctacccgtcgatggtcaacaagaaggactacaggctgttctaccgcatagtgttgcggggcggcatcctttggttcctcgcgtgcgggctggtggaagtgctggcaacgccgttgtgcgtgctgatcctcggcggacagtacgccagcgctggcgagttcctgcggatactgatggtcggcgtgttcttcggatatttcagtttcatgttcggctatccagcactctcgccgatcgggaaggcgacttgggcgaacgcggcgatcatggtcagcgcaatcgtgaatcttacggcctgcgcggttctgtggctgaccgggaacatcacaccgctgacggtatgcgtggtgttctccagcaccaacatcacgaccttcatcgtgagattcagcgcattcatgaaattcaaaaatctaacacgataaatctgtttttgacgcaaaggatggaataagcatgtctgtaacctcttacaccattacctgcagcagaccaactaattatggcgctgttctgcaaacttacggcttgaacaccgctctacgcaagatgggtgtggacgccaaggtgctggattacaaccccaaatactactacacgtctacgcggccgctgcctattcgcatgcttcgcgccatcgtacgcttccctgatttggtcaaggggcgcaaagtgttcggcaaattccttgaggactacatacctatgagcgccaaaacttaccgtacgcttgccgagattgaggctgacaccccccaatccgacgtctatatttgtggcagcgaccaaatttggaactgtaagaacaagcttaatggtaaagatgatgcgttcttcctgtcatttgcgcctgcgggcgctcgcaaagtagcgtatgctgccagcattgccatgcctgaaattcctgacgatcagaaggatcgttatcgtagactgatttccgatttcgatgccgtgtctgtgcgcgaaccgtcgtcggtgcccatgcttgaagatctcggcattagtaatgttcaatccgtcattgacccagtatttctgcttgagaaggatgattggaacgtaatcgccgatgccagcgatttcactcctactgaagattacgtactggtgtatggctataaccgccagaaagatgtatacgcttatgcacgtcggcttgccaagaagctaggcgtgaaagtctataccatcggtactgccatcgaagattacacacttgatcaggaccgttatttttggaatgcttcccctaacacttttgtgaacctgattcgcaatgcgaaagccgtggtgacaaattcattccatggcactgtgttctctattgtgtacaacaaaccattccacttctttacagttaagcagaccacaaattcacgcatgctcgacctgctggattcgctggcgttaaaagacagacatgttaccagtggcgacctgctaagcaaccacatcgactacagcgagcctaatcaactgctcaccaaagcgaagagctgttcacttaacttccttcaagtaaacgtcgctaacctacttcaggaattacactaatgaagaagataaatgtcataactgagccgttagtctccatcattgtaccgatatacgatgtggagaagtatctcaaccaatgcgttacttcgttgatacaacagacatatcacaatatcgagataatccttgtcgatgatggttcgccagataggtctcccaccatttgcgacacgtgggagcataaggatgatcgtgttcacgtgctgcacaagactaattctggcgtctcggcgagcagaaatgctggtctacacatttccaaaggaaagtacgtctgttttgtagatggcgacgattggatcgagcctgattttgtcgagtatatgatggcacttcagtccacagcgaatgctgatattgtcgcttcaagaaactgcttcactggtaccgatacctgtcaggaagcgcaggacataatatccactattggtccacaggaggcaatggagcttttcttctacccaacaatcgagcttggggcgtggaataaactgtacaaccgcggtttccttgtatccaacaatctcgagttcattaccgactttcatgccggagagggattgcaattcattactttcgcagcgagcaaagctagccgcataaccgtcggccggaggaaggtttatcactatcgtaccgataatgccaccagcgctacgaccaagcctgacgttgaacgacaaggtattggagctattaccactatgcagtatatctacgaacacctcgatctttccgacccaaaggttcgtaaagcttacgactggcgcttgtggagcacctacggctattgtctgcgacaaattatcgccacccatcaagaacgctcataccgtaatcttctacatacgtgtattcgttatagaagacgtcttgccttgcctatgcttagctctgatatatcaatcaaaagaaaactcatcgcgcttcttacatttatcagtccagccactgtcgcaaagctttctcttcgatgaaaacccaggctttccgttaaagcatggtttcgttacgccaaagcgcctttttcattccgtcaaatctcgtcaaatatactaggagtctttcctttggacacactctatgttttcattactacggcattgcccaaagctggagcgcaagttgccggattgccattgacgctgaatttgctacttactgcgtatgtaattcttcgtcatccaaaccagactttactgatgatgcaacgattccgaggactaacaatagcctatggaacgctgttcatatttggcgtgctatccatgctgatggctctagctcaaggagtgggggcatatactctttcgcaaatggttattgttgtgggatcacctttggtcggtgttgccgtgacaagaataaccagaagacaattcagcagaatcatcatctgctccatgttcatagttaatctgtacggcattattcagtttgctataggtatagagaattgtgcggtagcgggtatcacatacacattagggcaggactttacggataaagccattggattccatgcagatggaaccgtggaaaagataccctcaacctatcaaagtggtagctcactagggatttttaacgttctaggagtgtcctttctcttgtcgagctatcaggactcggcaatttggaaatatatgcgatacgttgcgcttggccttggactagtaggagttatgcttagcggttcacgatctattcagattcctttctttctgcttttaatcattttccttatacagttcgttaaacaactacctccacgtaaacgaagtatgactttgggtatcggaggaattgcactagcaattggagcggcatgcttatacgctcagcaaaccatcgtcggtcatttttttgatcgtctcgtcaaccagaccttagccgacaaaacagcaagcggcaggactgagcaatggtcacagagttttgaagtcatttcgcaaatgaacggctggcaactactcaggcagattatgtttgggcagaatcctcacactaatgtcggaggtgaagggttgccgaagttcttttttatgtttggcattgtttcaacaatagcattttatggtggattaatatatattattcggcgctgttggcaatgccgtagaggtcgcatcgtcgcacttggaattctttgtgttttctgcgctttctgcgtggatcaatcattttattatccacccaacatcatgaacatttcattattcgcagcagctgtgctaaaaaaaccttctttcgcaaaatctaatgagcgaataccgcagaatactgcatttagatcatcagcttccaattagctcttcatctgagaggtacacccgtatgagccaaaccaacatgacacaaatcactccgatacaacaccaatcaacgcgtattgcgtggattgacattgctcgcgctgtagccatggtgctcgtattcactgggcatcttggtacaagctggtttccgcagctagagccattgacgactgctatatacactttccatatgcccctgttctttttgctcagcgggttattcttcaagccaactatcgacctgttgacactaatagctaaacgagctcggactttgctggtcccttattatgtgttttcggtattcgcactggccgcgcccattgtaaaattactgtgcccttcgttatatcaggccgctggaaaatccacggattcgaatcctttcgaagctattgtcgctatcctctttgcgcaaggcaatgcaggattgtggttcctttggtcattgttcgtaggtaccctttgcctgtggattacggtgcgagccgtccgctccaacaagctggcgttgaccatagtgttattggcgtatcttgttatcgactgtcttcttaaaggctatcctgcagtggctcaacttcctttccaattaggtaaaatcttcgaggccacagcctacgttggcttcggataccttgtcgctcaaacttgtaatatccgaaactgggatcagctggagatcagtcgcaagcttggcgtattcggaattaccactgtggtattcctaatccttgaacactgctcaacggcgcagcccataacaagtggagtaatgcttaacgcactgctgctactcaccacgttctccggcatcgctatggcgatttctttcagcttgttattaccggaagcgcgttgcttcgccacggttgggcgagacagtctggttttttatgctctaaatgatattgttctcaaaacggttaaattcgccttattctccgtcgcacatattcccgtagctactttgccatttgccgagcagctttttactggaatcctggtgctcatcatggcgatgacgatttgctacgctctcaacgcttttgttcaacgatatatgcgctgggctatcggcgattttagtcggcacgtcatggctgaatgagaaagacgcaagatactagcgtatgcacagtccatattcgtgtgaaacgaactgtgcatacgcttagagaagagctgggaagatgacaaactaacagcattggattcgctgcgaggttttggcatactgcttgtagttttggggcatacctcgcaaactagtggcttggtatcatggatcttctcattccatatgccattgttcttcatcatttcaggaatgctgtttcacgaaaggcagtttctggattcattcaagaggaaagcgataaggctactcgtgccatacgtgttcttcggaacggtgactcttgcgtattgggctcttatcgagcgacgtctcaggggagacgaaggatctgttccgaatgcgctggcaaatattgttctcgctcgcgcaggtagcgataattacccgcagaatgcggcgctttggttcctgccttgtctgtttgtcacggagatgttgttccttggaatctttaccttcgtcaaatcaaagagagcgatccggtatgattgggctgttgccgcgacgcttgccacggtcagctttctctcaatcattgccatgcattccttcgatctgccgattgatcggctcgccttccttgggctcttgatatcctgcctttctccatgctgttctattgcattggctacttgctgagtcgttttctcatgccatgcatgcggaaatccaagccgaaggcatcgttgcatgctgtctatgctgctatcggtatggcaggacttggcctgctgagggtattcgatgagttgaccggactaagcgtcaacctcaatgacgcaagtaccagcaatccattttggatgctatgtgcagcattgcttggttttatatcgtcgctcatgctttgcgttgctatcgactgccggctgctgcagttccttggcagggcgtcgcttaccatcatgtgcgtgcatgaaccggtgaaacgagtgctgatttttgttatggcgaaaattcttgggatgaatacagatgcattgcgagcgaatcttgtatatgcgatgctggtgactgttgtcactgtagctatctgcgttgctgttcatctcattatgggcaggtttgctcccgtgttgatcggcagttcccgtcacaatctggcttcgcaaggcaaggcaagggcatgatgggagaacatttgcggttggcatcatagttgcgatggaacgtcgctttgtcgttgtgatacctgtaagaagtcggcatctcgatttcgctttgcccgttaattgcattcatccgcaatggtggtgtcaatgtgacagatgatctgccgcactgacaccactagcaagctcagctaagcgttcgcccttcctgcagatgtttaatttgcctttcgactccgtcccacaccagttcgaaccagcggccacggttacagcttacggtcaccgcaaacagtccttgacgcatgaagtcaatcagagtgcagacactaaatagatcgtcaacaggatgccgaggatttgcagaatggcgaaaggctgctgataaaggttctccagcacgaacaggtgcttccaaagcaatgttctcgtggcgggataatcggtgatcaggtaaaccgcgaatgcggaccgggctatgcggttgatgatccggctgcggaaggaaagccggtcgaacagtagaaacatgtcgaagcccaccatgatgacgggcagcttgaacgatccggcgatgaagatgcccttatcgattccgaacaacgataacataacggaagcgcatgtgtacaagaggaagaatcccagtccggttccggtcatcagccaagtctgtttgagtgtgaacggcttcatgtaccacttgtacgcggagatgaggatgaataggtagatgaagccgaacacgctatcgttcactccagaagttccgggaatgaagcttgtcagtccccagatcgccagcaccgttatggcaagcgcgtaatgcatgtgttcgccgagcgcgcgtagccccttggaaaggaacggcagcagggcgaggaaggtggcgtatgcggtaacataccaccacattcccataatggtcggcgcgacgctgcgaacgatcgttttcataccgaagtcagcacggtcgaaaaccagagagaatgccatgagcgctccagaacagcacttcgcgttccaaaatccatatgcgcttgaggttcgatttgatggtctgttccttgtcgaggaagaaccacgcggagatggtgaagaagatgacgacgcccactttgccaccaccctgcatgacgagctgaaagaagatcctctcaggtcccagtgaaagattcttgacgtcatagccgttatggacgacgaaatggtgggcaagaatcatgaacattgcaacgatgcgcagcagttctatgctggaattacgccccccaatttgaaattcgggtcggcgggacggccttatgggaggccgtggtctttgagcctataatcatctttcccttcgttttctcttatcttttccaatacccccaattatacccgtccgaaaagaccaagttatgaagctggcctacggccatcggcaggcccgcaggccgcatcgacgacggatacgaacctcgatcttacaacagcaatctatggaaaaatcagagacgaaaataaccaagcaaacaccccacacatgtagacaacagctaacgtccagatcatacgggaaaaactctggtttgcttccgtatctcgcttgcatatggaccggcacggaagcaagaaaccacaacacgcaccaccaaaggtgggtagccattatggctatccaccttcttcttaaggagcgcaaacgatgcaatcgacgtcaaacatatcggcaagtaaaaggcatacagaatccaaagctcacaataagcatgacgcgtttctcagctcgtccgtgcgagttccatccattcgtgaagctcacgcgggaaatccaagcccatctcccggtaaacagagtcgacgtacgcaggtatgtcttcacctaaatgcatgagcaaagaattaaattgctgaaggaattccagataacgttttttgtcgattacgaaacgtaaatccttaacaagctggaaaaccgtattgttggaatcatgcggatgcgcacaataaagacgttcatcgtgcgcgcaaatattacgaaaatctttcattctgcgatatatcttatcgatacgttgtgcatcgattcccgtcttatgcctgtgcgaatctccatacagaactgtgaaactcctagcaattgaaccgcgaatcaatatattttgagactgaaagaaccaatatatttgtcccaaagttagatcattggtcaaaacccacaacggcacctctccatcgtgctcattgaggcaatgaacgagatattcttttctgccttttctctcgcaatcactgttgtcagtaagtatcttttgcaatcgcggaatgagctgacttgccttttcatgagcttggccggtacgagcataattgtcgatattaaggtaggggttcttctcagccggatttgccttggtgaattcgtatgcgcagactgttttcagaatcgcctcagcaatcgtgatcattccgaaaaggagaaaacggagctgcctatcaaacaggtacagcttatacaagtcattgtatgaggatccttcgcgatatttgtcttcttcatcttttttcgcgcttgattatcgagaaacggttttttgtatccattgacagtcgcgtaatatccttcgcgctcaagaatccatgatgtcctagaatccgtttgaagtcctcgtgaattgagaagagcgatttgatcttcgatcatggtaaaaggtttatgcatgaagactccaatcaaagcacaaaggtcgtctttccaagaagaaagacgacctttgcgaactggacaccgcccagctttatcacaaatggctaatttatacgaaaaatggctgtttttcgacttcgacgtgtttcacatagtaagcgtccaaacagttccgcactgcccaatctcactccacattgatgaaaaactctttgctccgtgcaatacatctcccatcgcacacagccgaaacactcataactagatcatcgtagggagcgctttcctgcggaacaatgtcaatgtcaagattcgaacgcgacttgtgcggccaaccatagtccgtccacacaagtcgcgttccatgtctgcacaacccgagaaaagggcggaaaatactagttgtgcagacgcgacgactgcagatggaccgttgcgtatgcgcagattgcggaagcgatcaccagtagcagcgaaatgatggcgagcgcctgcactgcggatccggagcgaggcatttccggcttccccggcttttctggatcaccgggtttgccaggttcttctggttcttctggctcggcgacggctttgatggttaccgtcacttgagtgcttatgccatcatggtcggaggtgcgcaactgtgggcccgctcccccactcgagtttgtatctataacatcatccgcaccattgcgcacggcggtgatggtgatgttctggctcacggcttcgaaggctttcctcttctcaaccgcctgtattgcgctatcgatctgatcgttcaacgcctgcaactggtcactatccaccacaagacggtagtcggcgatgccgttcagttgtgtttccgtcaactctagtaggtcgtcggcactcagctgctgaaggccgctcgcgggatccaattccaccgaagtctgcttgctggagatcgccagatcgccgacatggaacattccgtcacccataccatcaccgctagtgccgcctggaatcagcccaagcgagtcagccaagtacggcgcaagattcgacaagtcggagaacgagccgctcaacaaggcgagcgtgttcagtccagctggaatcatgccccggtattcgccaccgcgaacagtcacatagccaagatttttagcgtcatccagcaggttgaaaagcgtcggtgcggtgaatgttccgcccgaaaaactgccttgcgcggaagtttcatccgtttcggcaaaccgcatcaacgttgcatccgaggtgaacgtgccaccctccacgtgcaatgcgccacggcaatcgaccgcaggctgtgttccgcccgcaaccgttcccgggccgacaatggtgagctgcatgttcgcaggcacagtgatcacagcggatccatcggcttgcagcacatgcccgttcaagtcaaacgttacgtttcgcatgcctttcagaggcgtaatcgtaacgctttccgcaacgtcagtcagcaatgtgaccgtcgcgttcttcatcgacgtatggccgatcgcctcctgtacgctcgcgtaggttgcgttgcccacttgcgcgaccgcctgagattcggcggcatcggcaactgcatctgcagagaacagcagcgttccaaacagcgacgcaatcgcgaaaacagcggtcagcaccaccgaaaccaaatacttaccttgcgttcgcgggcacacattcacccgcttctcatgactacgcatgattatttccttttataggttctgttgcatatttcaatccgcaccgaagtgcgtgggaccaccctcagctgtgagggataacgttacagaaatcatggcgccacgttgcattaattatctcacaatgcgcaaaggaaagcaaattacctattttgaaaatccaaatctcatatgagatatatcaaaagacaatctttagttatagtggacctcatcacataagttaaaactgtttcacatgagtatcacaatattcctcacacgaataaacgtatcccaataactgcaaaaatatacatatgacgaataattgtttcccatcaagaaacaagcgagcccacaatcaaacaagcgaggtcgcaaccacacaaaaacacatttcccatctgcaccacgtgggaaagcaaaagagcgctccgggagggagcgctctgatttgcacgacgattcgtgcgaaaagtactgcggaatttagtaagatccggtgccccggaagaccacgagcacggtttttgcgagaatcgcaagatcgcctgcaatagaccaattttcaatataggaaacgtccaaatattcgctctgctcctgcgaaagatccgaacggccggaaacctgccacggaccggtaataccaggcttaaccagcagtcgcgcggaataaagggaaccatagcgggcaacctcttccggcaaagccgggcgaggaccaaccaaagacatgtcgcccttcaaaacgttgaagaactgtgggaattcatccaacgaagtcttacgaataaaacgaccgaccttcgtaattctcggatcatccttcattttgaagatgaaacgatcggtctgtccattttcttcggcaagtttcttcttcaattcttccgcattggtgaccatggaacggaatttatacatggtaaatggcttgccatgcaaaccgatacgctgctgcgagaagaaaatcggaccaccgtcatcaagcttgatggcgatcgccgtgcccagcatcagcggcgaggaaatcagcagcgcgaaagccgaaccgacgatatccagcaggcgtttaatcacgtacgtcgtattcgtatactgcggcaaacttgccagcaataccggctgttcggccgtattacgcaagtacaggcggtggccgctcacgtcagccaaggaaacagccaacgcaagctccatgccaagcgactcgaccgcaagggaaatgccatgcagcatttcggaatcgcgggacagcacgtcggcaacatacacttcctgcgcacccaagctttcgcacgtacgcgggaaagcggcattgaacggaatcaccttcagcttgtcggcaccttcaatggaaggatcaggctcgaacgacgtgaccacataagcgtctttctcattgtcgtcagcttcgatcggacacacggcaatcggcgaataccccaaattggagtagtcccgcatggtgcgcaacgcacaattgataccgtcggaagaaccaatcaccacggtcttatacttacaggcgcccttctgacggctgcgatgctgccactgacgcatctgccaacgggcgatgacttctaggaagaatgcaatgatcggggcgacgataagcgcggttctcggcaaggaaagattgaaaataaaagcaagcgagcagtaagtgatgatggtgagcagcgacgcgttgatgattttcgcatacagctcgtagccttccgccatcacatgacgatgatacgttccggcaaaagtgaggctcaacacccagatgaggctgaagcagatgaggaacagccagaacggcatggcccccttgatggcattatatgcggcatcgttggcccaaagactgatggatagcgaaatcagcatgaccgcaagatcgaccatcaccaagcagacgacaaaagaataacgccatgcgggcacaacctgattccgcctgcccttgcgctttccatcttcaccaacggaaaatggcgtgttcgaaaacatcatcggctcaaactgagggctgttgtcttgagactgatgtcgctcctgctgctgatcctggtgacgagagttagaagagacgatatggatttcctgggttctcactacttgatccgaaccctgctcagagctgcggaaaccgccttgcatgactcctccctctactaactacccccacccgaaaagaagggggcttccctccatgaagagatagtatcataagccctgttaacagagtagatctccaactcgcttttgcggttaaatgactattggaaacttgcttttgacgcgataccgcgaaacgcgcggcaagaacggatgaaaagttggcgtccattccgtgaacgtgaggctacatgcgcatatacccacatattcccccatactcccctattgcaagatggcttgtctagagccgcttgcttagctgcttaggttgcctacggaactgtctagcggccttcgatcagcggggtctggcggagggtgagcggctcatccgtatctggagcggactgcacatgcacggtgatctcataggattcgccgggctgcaaggtcacatcgcccacgcccacggtcaggccatcgtgcaaagtcacacccttgtaatcgtcggcattctggaattcccaatccaccaaacgaccgttcgcaggcgcgtaaatgaacaatgccgtcttgatctggcctttcggaacgatatttccggcaccggtcacatagtcagcttcggaagccgcttcctccgccgtcatggtgttctgcaacttgatatgcaccgtatactggttcgcgccgtttcgcgcgaccttctggaattcagtggtcacttcgcgatgcaaataccagtccattttcgactcggtttcgtcggaaatatacacgccgacctgcggtttcgcaccttccgtaatcaatttgccggaaatagcggaatcggcaatcagattctgctcatcctcatgcgcgctccacaccatcacatgtccctgctcagcagatgtggcaagcgccttgacatacgatttgaaatcgcccgcattctgcatgatatggtcgaatgcggactgcgcggcaaccgcgaaatactcgtccgtctcctgcggagtcatgcgcgcatacacgtcgtgcagcaacgtttgggcagtattcgcaccatccaacgtcgaaccgtcaggcatggcaacgccaccggtcaccgccaacatgttctgcaggaacagcgggtcaatggcgatcacgccatcaaccgcaacgccatactggcgagcccacatggcgctcacaatctcgccggtacgcggaaaatcaggcgtgaaattcacgtcgcgaatatccttgccaagcttgtcggtgaacagcaaacgttcctcggcggtcaaatccacaaccggctcgtcggcattctgaatttccgaatcggaaacgaacggctgcaagctcacgtgaccgccctgcaccgtggccaggccaagcgatcccgtaaggccgccggaaggacgcgcctccgcattcgtttgcgcaaggatcagataattgcgcggagcatcattcgcatggctttccgtacccaacatgcttggcagcacctgcacgatggaattcaaggaatgcaccatgctgtcaagtttttcgcaatacgtttccgcggttttcagggcgtccgcgatctgcgcgacatgcggggttttcacggttttcacttcccgcgtggccttgtcgatcgtatcgtccgcgatttggagcggctgctgagacgcttccaatccggaaatttcgatcgtgccgttttccacgtgaatactgttcagatcaacattttcggcgactttcaccagttgcggcaacgcctgcgacgaaatattctccatggcggccaccgtggtgcgtacggcggaaatgtcatcgcccacatacggcacgaccgacgccacctgccacagcggcgaagaggtttgcttgtaggccttgcttacgtgatcggagaacgcggttgtctgcttctcaagcttggacgtgtccgcttcggagatggtctgctgcaagccttgagcactcgacaccgcctgctgcagctcgtttttcacgtgcagcgcagaccatacgaatgcgccggcgaaaacggcgagggctgcgactatcacgagtacgccgattaggatcttgcgacggcgacgtttgcgcttgatttggcgaatatgctcggcgctcatacggcggcgcacgcggcgggaatgcggggcgctggaagtggaatcttctggactggcggttgcgtcggaggttgaatcggcattagactgcggctcctcctgacggccttgctcaggctggacgccgaattcttcaggctgatcagacgcgccgttcatattccgtttcgctccctaattgtttgcaagcacttcggattccccagtgtaatagtagggggagtcgatgaaacctacggagcaaaaacggggcaataacggcggtattactgctcaactgttgccggtaacgcaagaactgatgcaacctaaacgtgacctgcaaaccagtattgctacaactcaagcatgacccgcgacggcagcattactgaagttccaacgtcgccaataatgccttgtggtcggaaccttgaatccgcttggtttccaaatttctggcgtacacacccttgtcgtagatgatatggtcgatttcagcgatagggaataccgaaggatacgtcatatgcaatccctcgccggcactctcccccgcatccgtaaagcgatcgcccaacaaatatctgaagcttgcatgatcccacgtggaattaaaatcccccatcagcacatacgattccccattatcgtaatgctgtaattgcgctatggaatccaaacttttattccataatccctgattgcttggtcgtggagaaaacggatgaaccgacccaaatcgtacttttctgccattgaaatcaactgtcgcggcaggaatactactggattcaataggaatgagatcctgcgttgtttcctgcagaggatgcgcactatacagtacgttcacaccgccattgtcgtgccaagtgagttgcgcggaaacggaatacggaagatgatcctcaattccagcatcatgcaaccgatctaataatcctgatgaaacttcctgcattgcaagaatttcaacatgctcgctttggattgttcgcacgatttgctgcgcatcggcacaaccttgcttcgtattgaacgtcatgacacgcactgttgcagaaggttgtatggcacgatcattggtcggaacgacatacccccaatgccagataatctggatgatcacgcacaatacgcttaacgcgactaaaagttttcgtttgccgacagtgcgaaaaactgttgcaataattgcgataatcacggaaaacaagccaagccaaggcatgagtgcgacaatcaaaggcacgtaccgtttgccatcgagactgttcggcagcatgcgcagaagcatcgcgaacacgatgacggcggatgcgaaccacagcaacgccgtaagcagtgaagcgcgcgtttcacgacgcgtctcacttcgttggacatcgccaagtcgagtcatgcgcactcctttcccattccatcttcccgtttcacttcctattccgcgcaatccgcaatcgtatgcaatcacatgttgcaaccgatagtcttacgcatcgtttttcacaacatctctcacaacatctcttctcgtgaacgctacccgcgttcatccccgcatatgtttcccgcatgcattgagggtgatgctttcacaaaagtgccactatatggacactttccggcatttggaatcgttctgatacgttcatccgataatctataggttgcaaaacggtgcttaacaaaagaggcaatcatgagcgaagaagcaatgcgagaagaagtggcgcaagctgtggaagtggccgcaaacaaggccgccgaagaggaaatcagcaagctggccgaattcgaaagcgccatcgacgaaacgctcgcctccggatatttggacgatacgctcaccgtcaccgacgcagacggcgtggcgcaagtgctgccagtgctcgattccgagccgatctcacacttggtggaaggcttggaagccgtaggcgggagcgccaatgtgttcgtgcacaccagcgcaggcgtggtggccctcagcgtagtggaatacaagcccaacgaagaggagtagccgtcgcagcatgcacggtcaggcggcacgcctacggttgagggcgcgttgcacggtttcatgcgtggaaccggcaccctggccgcgcacgccgaagaacaccatcagcaccatcacgaagcagattgctgcactgatacgaagcgcccactgaatgccgaacacgttggcagccgcatacacggcttttgtgccaccaagcgcagtccaacgaagagacgtgaacgtctccatcaaaatcaccaacaccggagcgccaatcgcgcccgcaatctgacgaaccgtattcgtcaccgcggatccggcgctcacctcttccggttccaaacaattcagtgaccatgtggtgatcggcatcaacacgaaacccatgccgatctggcgcacaaactgccaaatcgacacccaccaaatccacgaagtcatggaaatcaaactcatcatgaccgtgccgaaacacaaggtaatcgtgcctatcaacgccaccggacgtgcgccgaaacggtcaagcaccttaccaccgaaaaactgcgaaatgcactggcccaaagcacccggaagcatcaccaggccgctaatcgcagcagaatagccacggcaatcctgaatgtacaggggcatgatcaccataatcgaactgaacgcgaagaacgagagcgcggccgtgatcgtgccaacagtaaaactacgattcttcaacacgctcaaattcaacagtggcggctgcgcttcaggattttcaatctgcctgcgcgcgccatgaatctggcggagcacaaaccaaataattcccacaacgccaatcaccattggcagccaaaccataggatttacaaacgaatacgattcaatattcgtaaagccgaacattagcccgccgaaaccgaaaatagacagtccaacggaaaaaaagtcagccttcgcggttttatcgttctcaccgaaattatgcaatccaaaataggcaagaagcagcgaaatcacgccgataatggtcaacgtgaggaaaattgaacgccaaccgttcaagtccgtctgcacaccgccaagcgtcgggccgatcgccggagccacgctcatcgccatgccaaccgtacccattgcgaaaccacggcgagacagcggataaatcgaaaacaccgtgatctgcaacaccggccacatcacacccgtgccaaccgcctcaagcaaacgcccgatcagcaccatcaaaaaagttggaccaagccaagcgaacagtgaaccgatcgtgaacacaaccatggaaacaagcacgatttcgcgcgtcgaaaaacgtctcgtaaggtatgccgtaagcggcaccatcacgcccatgaccagctggaaaatcgacgtcagccactgaccggtcgtaacggaaataccaaaatcactgacgatcgtcggcaacgcggcgctcaactgcaattgcgtgaaattaccgacgaacgtaataaatgtaagaatcgcaatggaaataaacgccgtgcgcgttaaatgaccgtcctgatacgattcctctcgagtaagcgctcgggacatgctccgcttcgctgacatcaatcaccttctccacattcaaacgcacaaactatatgatagcccgtatgacagaggcatggatattcgcctgcggattcctgtttttgtcatttcggggtaacgctcccctatttagaggtatcatggcacacgaaagaggtaggcaagttttcgacgcaggcagcgtcgagaaggggggggtggaggataatgacagtcagggccatgttccacatctgcatggagttgtggggtattttcatatgcctgatttgcgcatgcggaattttcattgcaaccccacacaaaaccagacgaactcgcatcaaaatactcatgcagatcgcctgcatgcttcttcttggaaccgacgcgctcagctggtattttcgcgtagatgcagacgaaaccgcatactatatggttcgcataagcaatttctcagtattcttcatcaactatattttcatgagtttcttcgcaacctatgtttggttgacagtgagcaaacatcagcatcgcaaaccagccgcattgcgtgctgtctacgcattatccgtaattggaattctcttacttatcatcacacaattcactggtcttttctactatttcgatgaccacaatctttaccatcgcggtaatttctatcttctttcgcaggcaattgcggtcttgggaatcgcattatgcctcttcatgttgatctcatatcgcaagaatcttgatcgcattattttcctttccatgatgtcgttcttcgtgctaccagtattggcgaccatctaccaagcactggcatacagtttttcattgcaatgtttggcgatcgtgatttccacacagattatgttcgtcatggacaccgtggaaatgaacatgcgattccactcgcaacaggccgcctacgaaaaagcaaggtacgaagccgaacatgacggcatgaccggtttgctgaacaaagaagcgggatggaagcacatgcgcaaatacttcgaccgcatggattcgcacgacgaagcgatgctgatgttcgtcgacatcgacgatttcaaaaccatcaacgacacatacggacacacggtcggcgttttctggatccgcgaggtcgcttcccagcttcggcacatctaccggcacgatgacatcatctgccgatacggcggcgacgaattcatagcactcatccgaaacaccgccagcgaacaggtgctcgaaaccacgctgggcatgttcttccaacagttggcacgcgcctcggaacagcacgggcaagacgtgcattgcagtgtgggcgtgtgccgtattgcagccgctgacggtgccagccttggcacggggagcgccgatggagacgcgatcggaagcgtggatttcgaccaatgcgtcgcacaggccgacttggcgctgtacgaaaccaaacgattcaacaaaggaacgttcaccgtctacaactacgaccgttcccagccagcacccgcaaatatccgcgcctaaatgagcagcttcagctttccggcaattcctgcgctgggcaaccgtgcaatacggaaagcatcgtccgcttttcctgcgaagtgacagtcagcccgtacttgtctttcacgccaatctgccgggccacgtaatcgcaacggtattcactgttcgtcggcagccagtatgcggccgaagcggaacccttctgctgattcgcgggcccatccacggccagcagattgtacatgtcgttgccgaattggtacagcttcgcatgatcccacgtgttcgcgcccgactgccacgcattttccaacgcgaccacatgatcgatctgcaccgccgaagacgttttcactccacgtacgaattggatggtctgaccggtatacggatcgtcaagcgtgcccgacgcaacctggcagctacggccgttcttatattgcacgtccgtcagatcgcgcgcgagcacgtcttcgcgcacgtcgcaaccgttgccatcgtcgtcggtttcgcggaatccgaacgcatcgcgatcatatccggccttgctgggattgtcgtcgacggtaagtttttccaacgtttccgcagctgtgccggttgccgtgtactcgccggtgatttcgcctacggtcggattgactttcggcagcagcatgccgatagtgacgccgattaccgcaacgactaccagcaaaataagaatacgttccagcggaccgtcggcgttgatccaactttttttgaaccgattgccggcccgctggatatcacgcacgtcgcgttcaatattccgataattataagaattacgattattctttcgaggcataattattaaaaataatacgaaattacggaattacggagtatcaggcgtacgtgaacgtcatcggatcatgtccggcgcgcgtcggaccgtcaagcgcgtcgatcgcggcatgttcttcaggggtgagcacgaatccaaacaaatcgagattctgcttctgccgatccgcatgcaccgacttggggatgatgatcgtgccattttcgatatgccaacgcagaatcacctgcgcaggggtaaccccatgctccgctgcgatgcgctcaatcgcaccgtttccggcgttcaaatcagcaccgcgagccatcggcgaatatgcttccacggcaatgccgtgcgccttgcaatagtccacgacctcgcgctgctgccaggtcggatgcagctcaatctggttgacggcaggatattcgccggtctcctcatgcaagcggtcgagatgctcgggcaggaaattgcacacacccagcgtgcgcacgcgcccctccgcgcggaattcctggaacgccttccacgtttcactggaacgccagtcgaacggggtgggccaatgcagcatgtacatgtcgacataatcgagctgcagcaagccaagctggcggtcgaacgccttgcgtgcgctgtcatacccctgctcggaatcgcgcagtttcgtcgtaacccacaggtttttgcgctgctcaccttccgtgaatcccgcattgttcagcgcgcgacccacgccggcctcattgttgtaccccgccgcgccgtcgatatgacggtagccggcttccagcgcactctccactacggaggtaacgccctcatcgtcgatacgcagcacgcccaagccgatttgcggaatcagattgccgtcgttcaatgtgaccatgggggtatggaaagttgccatgcgttgtcctttcgaaggctgtgtttcaggcgattattctcaaccgttctcatgcttgttccagcttagccgcaggtcgccgcaattcggccatatttcgtggcacatgcctcgcattgcgtcttggaacggttcggacgcgccgttgcatgagtcgcgcatatgccgacagatgatatgcgcgtacgtaacataaccgcgcagtctcgtgcgctataacattgctcggataaagagggcgacgaacatgaacagtacagacgacgcgaacgatatggacggcatgggaggcatggtcaatgcgggtgcgacggatggcgtggaatgctgggaaacggcacgggcgaatcacgatttctcttcccgccacgggcacgcgcttgccggcatgcttggacctgcttttgtggcggccgtcgcctacgtggatcccggcaatgtggcggcgaatatcacatccggcgcgaggtacggatatctgctggtgtgggtgctggtactcgccaattgtatgagcgtgctcattcaatatcagtccgcaaaacttggtatcgtcaccggaaaaagtcttcccgaaatcctgggagaacgacttggcgacggcggtcgattcatgtttttcatgcaagcggaagtcattgcaatagcgactgatcttgcggaagtaattggcggcgcaatcgcactgaaattattatttggacttccgctttttattggtgggtgcataatcggcattatttctacggtcttgcttatttttcaaaagagtgccacgcatcatatttttgaaaagctgattattgcattgctgctggtgattacttttggatttattgcaggcctttttattgatccaccaaatcctgcgcaagttttgcaaggtcttgttccgcatttcaaaggaaccgaaacggtattgatggcaacttccatgctgggcgccacggtgatgccgcacgcgatttacctgcattccacgctggtgaacgaccattacgtgccaggagagcccaaaccgagcgtaaagaccctgctacacggaagcaaaatagacgtgttctgggcattattacttgctggatcggtgaatcttgcactattgattcttgcggcgaattcattgcatggcatgaccggcacggatacgatcgagggtgcgcaacaggccattcagcatgtgctaggtccggtgatcggcacgattttctcggtcggactgctggcttccagcctgagttccacgtcggtcggcacatatgcgggcgccgaaatcatgcatggactgctgcggatcaaagcgccgatgtgggcatgccgcgtggtgacgctcgtaccggcgttggtggtgttgtggtttgctaagaatccgacggaagcgctgatcatagggcaagttgtgctgtcgatcggcattccatttgcgattattccgctgatgaaatacactcacgaccgttctttaatgggcgattatgtggatggtccggtgaaattcgcgatcaatatggtagttgtttcgctgattgtcgcacttaacgtgattcttgtaattctcacgctctccggtcgttcctgatgtgggtcccatttcggtgtccgcacagtcgaccggcgcagctgcccgcgcaggaattgccggaacaccgaggttgattcgggtctgcacaaacatcgcgagctgcgtcgcgaagccaacgatacgaaatcaacagcacaaagggcgatagcgcgaaatcaacggcacgaaggacaacggtacgaaaccgatggctcgaaagccgacggcacgaaaccaacggcgagctacacgcgcgtggtggcacgggcgatcacgtgcgactgggtggtgatgtaactcggctccagcacacgcgtgccgtcgatccggtcgagaatgcggctgaccgcagtcggcgcaatccagtcgagacaagaatccatggtggtcagcggaggctggaaatatgcggcttcttcaatattgtcgaagccgatcacctgcatctgttcaggcacggaaatgccgttcgcagccaaagtgaacagcgcacccaacgcaagctggtcattgaacgccacaataccgtcgaatggaatcccggaatcaataagctgctgcgtaatgcgagcgccggaaccaatcgtccaatcctgcccagtgctcattaccagtcgggaatcgaatgccgctccccgcgcggcgcacgcttcgagcacgccgcgaagtcgcagttgcgcattgccttccactgcttcacgcacggaatcgatatgctccggttcggttcgcgatccgaccaccgcgagccgggttgcgccatggtcgaacaggtattcggctgcgagtcgggcttcctgaatatcgtcgggggtaacgtggtcggctttgccgtgtgtggaacgcgcgcccacgcatacgagcggatagtccacgtccaagtccgccgcttcaaggttttcgacttcggagatcgacaggatcatgccgtccgagacggtggtgttgaagttgcgcaggagtgattgcgctccttgtgcggatccttcggcgtaggtggtgacgtatacggagtagccgtagccgcgggccgcgtcgattacgcggttggcgagctccgacaggtatggggcggtcaatgttggtacggcgagtgtgatgaaaccggttttgccgcggttgagattgcgcgcggacacgttcacgcggtatccgagtcggtcgatgacttcctggactttttctcgcgtggagtcggtcatacggccggaatggttgatcacgttggatgcggttttgagtgaaacgcctgcctcttcggccacgtctcgtagggtgacgcgttttttgtccggcttcggctccggctttgactcgcccatgttcgtctccgtgattgttgaatatgccggtaaaaagtttaccagttatggcaagcccgccattcttgagtttcagaatggcgggctcaggttgtgtgagattgttgtattacgcaatcaattgcgcgaaattatgcgaaattatgcggaattatgcgcgctttacgacgagtacgccgttgcgatgcacggtgtagctgcccgtctgttcctctgcttccgcttggaacaggtagattggttcgccttcgatgccctgcaatgcgatttctttcttgccgcgcggcagatagaaatcgaaggttgcgtcggcggacttgcgcacggtgtgcagtacgtcggaatcggtcggattggcgacatttgcggaatcttccacgatattctcgcgcacgaattccgtaagatcggcgacgttgagatcgcagccgacgaagtatgtttcgccggaaccgtacggattgcgggtgattgcggcggtgccgccgagttcccattcgtcggcttcttcaccttcgtaggtggctaatacctgcgcgcgttcgccgtcgacgttcacatcgttctgccacaggcgggtgaccgcaccggagctcaaacgaatttcggacggttcgccttcggcttccgcgccgagaatgttgaattcctcgccgcgaatacccagcatttcgcgcagcaggccgtctccggctcccgggtatccgccgagccaggtgtggaagttttcgtcgatcagtccggttgcgtaaccgatgaccacacggccgccggcagctgcgaaatcggccaaacgctgcgtatcttcggcgctgagcatgatcacggtcggcagtacaacggtcttgtatgcgctccaatcgtatttcaacggcacaatgtcggcacgggtgccggcgttgaggaacgcacggtaccagtcgcgcacgtcatgccaatggttgagcttcatgctcggcagggtttcggagcgtgtggcccattcggattccgcgctgaacaggatcgccgtatcggactgttccagttcggtaccctgcacgccagcgtcgccgagggttttcagcgctgcgcccagttcgcacacttggcggaacagtttggtgtcttcgcccgcgtggggcacgagtgcggagtggaaggattcggctccgaatgcggaggcacgccactggaagaagttgatggcgtcggcacccatggccacatgcgcaatggagtcacgcacggtttcacccttgcgcttgcgtgcgttgagcggcttccactgcacggccgaagtggaatgttccatcacataccacggcttgccgagcgcgagggaatccatcaaagcgtcggagcagaacagttcgtcgatatgcgattcgccctcatggaagtaatggtcgttcgacacgaaatcgacttcctcggcccagtcggcgtagtccatgcagcactggtcggtggagaccatgaagttcgtagtgaacggcttgtcggggcagatttcggcgatggcgtcgcgttcggccttatagaagtcgagcagcatatcgttgccgaaacgctcgaaatcaagcttttgaccggggttcaccatggagtcggcgcccatgaaacgcgggatgagcacttcgtggaaaccgttcatttcctgaccccagaaggtggtgccccacgccttgttgaggttttcgatggtaccgtatttgcgttcgcaccacaggcggaaggcattgagcgcgttgtcggagtaatcgtaacggttgttccagccgtattcgttgcccatatgccatgcggtgacgtacgggttggtgccgtagcgttcggccagtttgcggcacagggtgagcgcgtattccttgaacaccgggcttgtcgggctccaggattggcgcgatcccgcgttgacgggatggccgaatttgtcttgcggcagcacttccgggtgcttttcgtacagccacagcggcgcggtggcggttgcggaggccagatcgaccgcgatgccggctttgccgagcttgtcgatgatgcggtcaagccagccgaaatcccaacggttttcttccggctgaatgcgatcccagctgaaaatggccacggccacggtattgacaccggcctgtttcatgaggcggacgtcttcgtcccacacgtcttccgaccactggtcgggattgtaatcaccgccgtatgcgatgcctttgccgttgtcggtcagcagttccggccatttgaacgtgcgatgcatggattactcctttgtgtgcgtatggcatccgctataacgccgaggatgccagctcgacagcttcccttcgaaagctctcgtaaaatctttttataaaatctagtatatatatttactaagatatttgagatggtcccggggatgtccacgatgacacccccgaggtcttatttttgttcttttcggacgattgccgaaaaatcggtatgcgctttaccgaaatttcagcatgcgaccgttgcgatcattccttgacggcgcctgcggcaaggccggactgccagtacttctgcaggcacaggaacgcgatgaccaacgggacgatcgtgatcaacgaacccgtgaccaccaggttctggatcgcctgaccgccagcggtgctcgcctggtccttccactggttcagaccgatcgtcagcggataccagttcgaatccttcagcatgatcaacggcaggaagtagttgttccacgtcgccacgatcgtgaacagggccgtcgtcacgatccccggggcgagcagcggcagggatacctggaagaacgtgcggaactcgccggcgccgtccacgcgggcggcttcgagcagctcggtcggcacggcctggtcggagaagatccacatcaggtacaggccgaacgtcgacaccaggctcgggatgatcatggcccacggggtgttcgtcaggttcagcttggcgaacagcaggaactgcggcacggccagggcgatgcccggcaccgagatggcgccgatgatcaccgcgaacacggccttgcgtcccgggaaacggaacttcgccaggccgtacccgcccatgatggcgagcagggtcgcgccgccggcgcccacgaccacgtacaggatcgtgttcaggaaccagcgtccgaagatgccgtcctggtaggtgaacacggtcttgatgttgtcccacaaagcgaacg

SEQ ID NO: 80 - DNA, 81094 bp, Bifidobacterium pseudocatenulatum
cgagcggacgatgaactggcaatcattgactataaagaagtagtacaaatacgctcttgagttctcaaaccaccaccacaccagcagaccgtcccgaacctcaggagcggaaccgccgtgctgagcagcgagatgtaaacttacacgtccttgccgatctacgcaaatcgaccttccgcaaacaccgtgtaaaccgttgaaaaataacgtatctctcggcgtgtcgaaatcgcaggaaaatcgagtgatgagcaccatttcacagcacaatcccgctggaaaaacctcaacatacctcgcgacaggtcaacatccgggcgtgtcgcacacgagacgaacgaatgacagaaaggtacaagacaaacagcgggcaaaacatccagcgggaacagacacaacacgactacgcctgacacacatccagcaacgtcaattcgtccgaccaacttacgccttgccacacaacctgcgagcgactccgtctaccagcgcttgccacagcgcttgccaccattgccgggcctgccaccggcgccccacggcccgcgcccctcggcatgcagcacacccagatgatgcttcatggcgaccagcatgatgtgcgtatcttccaagccaagatgtcgttcgcttttggatgcatccaacgcgccctgacgtttggcatacgcatccaacgtattgttgccgtgcggatgctcatcatcgggaatcgacccctcatcccaacgacggctcatcggcaatgtgtcgatgatcgtgatattgccggcacgatagctttccgcatatccggcgacgttcagcatgaaaaagctatgctcgaaccgggcgttatgcgcaacatatggctgctgttcgagtcgttgcagcaatccgatctgagcttcgggccattcgtcgaacagacgaaagtccgcgctggcgcgatcgcgcacgtcaataccggtaaggtcgagaatcagaggattgccaagcagcgcattctgcgcgggaacgccgaaggaaagacgtgcctggccatatgcatcgccggtctcgtaataatcctgttcgtagcggtagcccgcgggctcgccggcaggacgaggcgagatcatgttcatgaattcgaatccggcatcgatgatgtatacgcgagccggatccgtacccgtagtttcgatatcaatgcccatcaccgtgtcgacgtcacggccgggaaggtaggcgtcacgccaatccgactttttgtaatccgccaaacgtcggtcctgcgcggcttccgccgagtcagcggaaccgccagcggatccgagggagccatagtcgaacaccttcgagcctcccggactcgtcaccccgctcaaattcgcgcgtgacatggcgtaatcgctggcacgcttctgctcacgttccgcggcacgacgttcggcacggccattgacgatctgcgcggtacgatcctgaatatcgttaagattcacgaggctttccgctccggcaacagactgcagcacgggcactatcacccgctcccgccgctcttcggcaatcgtccacaatcccatcgcaacaccaatgcgccgcaacacggcaatttcgtcgcacaacctacggttcgcataggcgagcgcgcgaggcaaacggtatgaagcgatcagacggtcgaaatccgtcatgaaggtggtattgcattgcgcgatgatggattcgagccggtcacggaccgctaaatcctttttcagcagattatgcaactgttggacggatagtaccgaatcctgcatgggatccgttttctccgaggtcgacgaaaacgtggtatccgcggcattcagaacggcgatcaggtcgatgccttggcttttggcgactccgatgccgtgttccaagtcgagagacatgacccaatgccagtcgatgcgctcattgtcggcgtttttcggcatcgatgccgaccattggctgatgtcttgtttggcttcggtaagccaggaacggcccgtctttgcttcgttcatactttgcatggtagccgagagggggcgcagtacacgtcggcgcgtacaaaaaaccatgatgcttctcggatagcgcaatcttaagttttttgagattcgaaaggttatcttgggttcgttttatttcgttgattttcggtaagagaaagaacaatgctacgaaaaacgattatgttcaccaagcattcgtcgtcaggatacgatcatgcgcgttgcagacggagcacgacgtcgcgtacgaaatcattccatcgcaacgcgaacgccgatattgtcgataatgctgcgaaatgcaaacatggttacgctcatacgtgcgtctgccgtggggagtgtgatgcgtgcgcgcgttgcactggttatgcgcatggtggtatgacgaaaaaatgacggtatgacaaaaagggagaggcctgtggacctctccccctgcaggatattccgcggattgcgcaacgataggattccgtgacaatcggattccgcagcgtttttcgccgcgcatgtatgcgatttgcgacgtgcgctcctggtttacagttcgaatccgagttcggcggcggcttcggtgggaaccggatcgtcgcaccagaaatcctcaagattctcgttggtggcgaggctgcggatttccgccttgtcgatatacagttcgccgctcagatggtcggtttcgtgctggaagatgcgggccggccagccgtgcagatgttcctcatgctgtttgccatcttcatcctgccagcgggcggtgatgtcgagccagcgcttgcgtaccgcctgatagccgtcgaagctcaggcagccttcgtagaagctgcaggtttcggtgccgatcggctcatagctggggttgatgatgacgtggaatgggaattcggacgcttcgcgcgggtcatcgtcatcgtcgtcgcgcacatggtcttccaccacggcaagcgccagtccgaggccgatctgggttgcggcgagacctacgcccggcgcttcgatcatggtgacgcgcatggtttcgatgagcttgtcaagtgtcttgcggctcagttggccttcgtaggctgcggtctgctggcgcagtaccggttcacctgcctgcacgatgggaagcagctgttccttgccgccggttttgatgagtttttcgacctcgcggttgagctcgaggttgactttcgagttacgtccaaacatggggttccttcgcggattggttcgggattttggattgccaaatactgtgtatcggcggtgtgattacaaggcgagttcttcggccacgactttggcgagacggtcgcagacctcgtcggcctgctgctgggtttccgcttcagccatgacgcgcacgagcggttcggtgccggagggacgcaagagcacgcggccggtgtcgccgagcattttctcttcgcgttcgacggccgcctgcactttggcgttggttttggctgcgagcttgtcgacgtttggcacgttgatgagggtttgcggcagttgcgggaagtcggatgcgagttctttgagactcttgccggagttgaccacttcgttgcacaaggtcagtgcggtgagtgtaccgtcgccggtggtggcgaattcgcggttgatcacgtggccggactgttcgccgccgagcgaatagtcgccgcgcagcatttcctcaagcacgtaacggtcgcccacgccggtttgcacggttttgatgcccatggaacgcagggcgagcttcaggccgaggttgctcatcacggttaccacgagggtgtcgtggttgagtttgcccgcgtttttcttggcacgtgcaagaatacccatgatctgatcgccgttgaccatattgccttcgccgtctacggcaaggcaacggtcggcgtcaccgtcgaatgccacgcccaagtcggctccggaggctttgaccatggcctgcagctgttcggggtgtgtggatccggcgttcttgttgatgttgtagccgtctggcgaagcgttgatcacgatcacgtcggctcctgcgcggcgcaacgcttccggcgcgaccacggaggtggcgccgttggcgcagtcagccacgactttcaagcctttcaacggtgtcggctgggacttgtcaggcccgatgggggcgattgtggataccagatggtcgatatacaggttggttgcggttgccgtgtcgtggctgatacgtcccacgcctgcaccggtcgggcgttcccaatcctggccgagcacgttttcgatttcgtcttctttggtgtcaggcagtttgaatccgccgcgtgcgaagaatttgatgccgttgtcgggcatggggttatgggatgcggagatcacggcacccatttccacgttcagcacggaagtcaggtatgcgacgccaggagttggaataatgcccgcgtcgatcacgtcgaaaccgcctgcggacatgcctgcggacagtgccgctgcaagaaaatcgccggaaacgcgggtatcacggccgaccagtgcgcggcgacgaccgtcgaattcgcttttgtctccatcatcgccaagcacgcgcaccgcagcatcgcccaaatccaacgcaagctgtgcggtcaaagccctattcgccaatcctcgaacaccgtctgttccgaacatacgtggcatgagtctcaagtcctcgctatctcaagttatattgccgtgcaccatcgtactcaacgggttcaccattcaacgaaacagtcgagagcatgttgcgatacctgcatactgcggtacgtaatgttgcgcaaaccgcagtatgcaacggcgcgggcttttccgcaatctcacgttttcgcaatatcgcgttattcgcgcaataccgcattcgacagttgcgccacgaacaggccttggtctcgagtgacgatttgggcgcgaccgggcgccgccttcttcggtttgactttgccgatcagctggccttcgttcgaatctccggacagcagaatgccggtcatgccgagatcatggaacgtctgcaataccggatcgtacatggctcggctcgcaccgccggttctgcgggccaccaccacatgcaatcccagatcggaggcctgcgccaaatatggcaccaacgcacgcagcgggttgcctcggctggtggagaccaaatcgtaatcgtcgaccagcacgtaaacttccgaacccgtccaccaggaacggtcgcgcaactgttcggcagtcacgtcctggcccggaatgcgggttttcaggaattccgcaagcgcgtcgagactttccgtagcctgttcgtcattggtcaggtacgctccaaaatgcgactgcggaatctgcgcaagattcgcacgacgataatccaacatgaaaatttttgcttttccatccggatagcttcgtacgatttcgttgattatcacgcgaaggaatgtagatttccccgaaccggcgtcaccgaataggtaacagtgcggttcggtgttgaagtcgaacaccactggagacagtgcgttctcgtcgataccgaccaccatgttgcctttggcgagctggttggatgccttttgacgcatgacggaagccatcatcgcctcgtacggcaggttttcgggcagcaaccgcagcttcggaccatgcggatggccttgccatgcggaacgtactttggcgatgagatcgttgatgccgtcggacaccgtcgccgcatcatgcccgccatcgatgcggggcagcgctgcgagcgtatgcagtttgttggcgctcaggccacggccaggcgcgcccttgggcacggtgtcggcaacgtggcggtcgatttgcgaatcgctcggatcacccaaacgcagttcgagcttggtgccgataaggtcgctgatattggcacggatttccatccaacggttcgcgctgaacaacacgtgcacgccgaaggtgagaccacgggcaacgatctgctggactttggtttccaattcgtcatagtcgccgcggaatacgccccaaccgtcgatgacgaggaacacgtcgccatatccgtcgtcgaccttgccttcggcgcgacggcgacgatacgcgtccatgccgtcgatgcgctgttctttgaagaatcgttcgcgcgcgtcgatgatgccgctgacttcggcaagcgtacgacggactttttcatcctcattgcctgccgcgatgccgctgacatgttccaatccatccatggaggagaacgcgccgccaccgcagtcgatcacatagaactgcacttcgagcggcgaatgcgtgagcgccaacgatgcgacgatggaacgcaacatcatgcttttaccgctcaacgggccgcccaccactgccacatggcctcccgcaccggcaagattgagggccatgacgtctcgcctctgctcgcgtggcttgtcttccaacgcgcatggtacgacaagcgctccggcattgcgccaccttggcgaaatcaagccatactccttggtgacggtcaggtccggcatgaaatcgtcgagcgaattcggcgtgaccagcggaggcagccacaccacgtgcgcgggattgcctttgcctcgcatctgttccaccgcatactggaaggtggtggtttcgccgtccaaccccttcggcacgcccgacacgtaagacgcgcggaagcgggtgatggtgccgtcaggcgatttcagatagccgatgccaggcaggcttggcagatcgtacgcgtccgtaatgcccagcacggcacgggattcggttgcggagaacgttttcagaccgatacggtatgacaggtgctcgtcaagaccacgcagcttgccttgttccaaacgctgcgatgcgatgagcagatgtatgcccagcgaacggccgaccgcgccaatgcgaacgaacgattgcacgatctcgggtttcgccttcaacagttcggagaattcgtcgaccacgaccaatagtgacggcaacggtttaagatcgctacgcccgccgttgacacgcatctcctcatattcggtgatgttggcaaggttgcccgcatctcgcagcagctcctgacgtcggttgacttcgccatccagcgcgtcttccatacggtcgacgagcgacgcttccttgccgagattcgtaatgatggatgaaatgtgaggcatgccgtccatacctgcgaaagtggcgccgcctttgaagtcgatgagtacgaaattcaactggtccggggaatggctcaacgccaacgacagtaccagggttcgcagcacttcggatttacccgaaccggtggcgccgacgagcacgccatgcggccccatgccatgctggcccatctctttgatgtcaaggaacgcggtactggtgtcgtcgaataggccgatcggcacgcgcaaacgctccttgcccacacgatatgcccacagtttcgccagatcgatatgacgaatatcgctgatgccaagcagatcaggcaattcgggggatttcttgcgattgacggattgtgaggaatcgtctccggtttcgttaacatgcacgctcttcaagcgtttcgctatgcagagcgcctcttccacagtcaattcgtccggttggatttccacaggcttgagtgccgtggaaaacacttcaaccatattgatgtcgcgcttttcgagaacgttcagtccttcctcaaccacggtctgcgaatacagcacacgaagcacgtcatcttcctcgagctccccccaatcattcggcatgtcgaacacggtcactccaccgaggccgtcttcagcgaacaatcgggactctcgagacaatacagtccggtcgaatccatcattgatcaccaaaacatgaggagcaatctcattatctccggtacgcctgttgcggttcagcacttcctcgcctatcagcgcatcaacttcgcgcacgttgctcgtcagcataaatccatgaccgttatacgtgccttccaagtatttctcgttcagcacacggttatgaggcagcaaccgtacccattcccactgccccatgcgatcagcggatgccagtacgagcactctgcagcattcagccggatgccaaaccgccgcttgacagatcatggctcttgcgagcgcctgcgtctggctttcgtttccaagcaattccacacgcttgtatttcctcaggtcaatgccgtaaggcatattgtgcaacgttttatgtgcaagcatgaaacgatgcgccgccgatgccgaaaccgggtcgagctgcgcgagtggaggcaattcaggtgattcaagctgcaggcacaatggcacactatgcgtgccgcaacgtaatatcatgaaatcgtcgtctgcgggaacacgttcccagcaacgttccggttcctgggcgatcgccgtcaacgaggatggggatggagcgttccacaatgcggcattgcgttgtttccttcccgcggtgcgcacggttttgcgtatgccagccaaataagtgagatattcacgtcttgccgccgcgaggttcgccatgcgttgcgaacgttggcggaagccgttgaccgccacgaatcccaatgacgacaccatgaacatgccgccggtaagcatgccggtgagtcccgaattggtcatcagcatcatgaccatggcgctggcggtgcccaacaatggcaccaacgatgtgagcagcgtgttgacaccgtcgctgggttcaagctcgggtggtgcctgcaatacgatttttccttttggaggtttgggaccttcgagcctgctgttttgttgttccgcagtaatagccatcaacgcctcctgcttttcgatgtgatgatgctgcagtccatgtctcccagtccgatgcgggatccgacatgcatacgcgttcggacgttcggttcaagttccgtctcttcgccgctttcgtcaagcactcgcgtaccgttggtgctcgctaagtcagtgatccagatttggtcgtccaccaattcgatccgagcatggtttcgtgagaccgtaccagtatggtcaggcacagccaacgcgatgtcccctgtctgctgcggggctggcttgcgcccgagaatcaatgaagaaggcacgctgagagttcgcttggagccatcttcaaagaagagaaaggtttggggtttctcaggaggtgtcactggcaccgaggccgtctgttgttcaaccgttgtccgaaccggatacatcggcttttccgaaggcatgggtacaggagaaacctgttttgccgttggcatgggaaccggtttggacacgtccgccactgttttgggaagaggcacgggaggagtgggctgcatccgaggcatgggaaccggaggaatttgcctcgatacgaccggttgttcctccaacgcctcaacacgttgatgaatatcgacgcatcccaaagatgccagtctgtctgcccatccctgatgcaaatcatccttggcgaacaacggtgagcaaatcaccgcaatcagacctatgaccaacgcaagcgtggatccgataagcacacaatacttcacaagaatccggcccattccggcgggcaaagttcccgccgtgacgtcacgcatgccttccacgcgaaccgtacgcaaaccgaacatcatattccccggagtcagaccgcgcgaaccttctccaatagccagcaccgcaaccgattcgagcatcaccaggaacgtgacgggaatattatgtccgagcaaagccgcaatcacgccgcaaagcaatacgaaaccgcaatcgacgaatgcggccgcacattgttttccggctcctgccggacgacatctcattacggaattcgaatccgacatcacaatccccttatgtactgcaacgcgccagctgcgaagaaagccgccacaggcgtgaccatcatggacaggaagcacaacgcatcgccggcgcgagacaatacaagcgaatgaaaaccgcctttttgcacaggaatggcatataccagcagaacgccaatcaggccaatcgcgcatacgccgaacagcctcatgttttcggttgtcatgaagccccaggccctcacgcaggccatagccatcaccatcaccgcagacaaacgcatgcagtaccgttcgaaaggtctgcccgaccggcgcggcttaagggtgagaaagagaaacagggccgcggtaagcacgagaaagccgacagcatcatacatccgatggaaatcgcagaatgcgaccaatgccgcgtacggcaataccagcagcgccaagcaaagcacgaaaccggtcgcgtatcgggcctgaaacgtctgcatatcttcacgaatatcaacttgggtcaatacacgggcctcttcgggaatgccaccgcgcaccgtccaacgacgtgtcatgtaggcacgccattgcacaagataacggtccggcacatgcaccacgatgttcggcagcatttgcagacagcatatggcagcggcaagcaccaaaccggcaagcagccgtacgtccaacgaacacatcagcgttcccgtactggcgagcagcaacagcaacgatacggcaaagcatgcggatatcacgccattaagcaccggctgatcaatgcaaaccgtcattaacgacatattgaggcatacgcaagaagaagataggaaaaccgccgccgcgatcggctgagcgcaaggttcaacgcagctcgccgccacaccggcacacaccgacagcagcacagcgcaagccatggcaaccagcgcaacggtttgctcgtgtgagcgtatgctcaccacgcataaccgatcacaaaacagcatcagcaatatgaggcttgccacaagcagcacaggcaatcctcgcatccgctcgtcgccaccgggaagcaacacgctttcggacagcaccgtaacggcaataccagcaaaaagcactgcgcagacgagcgatacaatgcatatcgcctgtaagtcagctggcttggtttctttgtgccgcatattggctttcccactcacgcagacgagtcattcctttatcgagcgcaacacgagcctgggccgcttcattatcttcgtcgtccgcatcctccacgctatctcgcacataactcatattctgcgcgaggtaaccacgtacttcacgcgcttccggagacttgtcaatgccagcaaggatgtcttcctcacaggttttccccatgtcgatacgctgctgcaatacttgccaagcgcgcccacattcacctttacgccgcttattttcaagttctttcgttttttcggctattttttcatctatttgaactttctctttttcgaatttcgcccgctgcttgtcaagccgggcagacagtgaatccatttggttcatgaaagcttcgaattccgctgatgtcattccacttctcttttcttcgcacataaaattgtcgtaccgaggtcatcgtccgtttcgcaatgcaagtcataacgatgcggttggaaggacatgacgattatcttccatcggacgatccaccggatgccccggcaaacgctacgtcattcgacgtactgccagttccaccgttcgacgtgcctccgccaaaaacgcgcagcatgccctctgtttttacggaaagccgttgcataaccatgaggcatacacacaatccgttaagggcttcatacagattgttaagatattccacgatatcggatgcccattgaatcgcctgggtgacttccgcagcgacagtgaccgtagcgagcaccggaccggctccaggaataatcagctcacccgcaataagcttcaacagcgaaatgatttcactcaacgtgtcgaatatcagattcaatgttttttccgcattgtccgccaaagcgttcaacgcctgggccatttccgaacatggctccggagcttccacaagcgcgtcggccaccgcctcattgcgaacaacatatatgtccgcggcctgcccagaccacactgtctcgtcgagactattggaaatttccaataacgccgtctgcacttcaggcagtgtttcagccagcgactgccattttcccgcagtatcgcgaagctcatcccaatcgccgaagaatggtttcctgacccactcatctataggactgacaccaaacaatgccttgcaaatgaagtcaacacctgagatggcaatgcgaagcgtagtaatcttgctatccagcgttttcgccaaatcatgcgcactttgacgagtcaaatccccttccaaagattctgtgaacctttttgacgcatcctcgaacttctggcttttccttccgatgtctttcttatcaaatcctgttttttccaggattctcccaaccactttgtcggctgacgtgtagccaaatttctgcccggaaaggagggctgaggcagcctttcccactttcctactgtcataggcctcgccgactttttgataaaacttcaagtcgcgtttaatgtcgcttaaatcgtctggaacatcgatggtaatcgggccgaaatgcaagtcgttggcagagccatcatcttcttttgcagccatactcttccccttgtgtatagtttgaatgtgatatttacccggttacggccggatatgctttgcacagcatcctgttttattgaatcgtcgtgcgttcaggtagctgaatggtttctctgtcttcgtacaaggcacgaagctcatccgccgttcttcccagaggatctttagctgcgatgctttgccaggcttcatcctcggcttgcttacgcatggcttcccttgccgcttcggaatctccgacgcggacggcgacatcgtaatcgccgtcattgtcgtagtcgagggcaacgtaccgcgaatcttcatcctcatatacgctgaaacgggcattcgcgcctgaatcggagttcatggacacgtcatccacgccatcgttgtccgcatccagatcaaacgaagcggatcctgttttgcttgcatcagaaggcatcggaatggtggaattgtcacgctttgtcagaataacggaaccatccgccccaatcacggcatgcgtattgccatcaatgagattcagagagtagtcgtctttggcgtttccatccacatccaatccaatcgtggttggtcttgttggaagtggaacctcattgaaaatcggataagtgttcgattccgccgcatcacgcgcaccatcagatgttgtttttttctgatcatggccgaattcttgcgatcccgacgccattgcaccagaacctgtcgcagatgatgccggacttcctgccgcttcggaaccaccgtcggatcgaccattaaactgatccactggctgatattgcttgctttgcaaggaatcagctcttgagccaccaccattgccaaagctgccgccatagccggaattgccgcctattccgccatttccctcggaccgtgcgttatgaggatccgaggaatccaacttgtcatccacctgctgaagcagttgcagaatcttcttcagcgcttcaagtatttcctcttcagtggtggtggaatcttctacggtcccctgtatggccgaagcaatcaatttcagcattgtttcaacgttggccaagtattcttgcgtagactgcttcgccgcttcatacgccggttccaggcatttgagaatcagcccgaaattcggggttcccgcagacacaaactgcgcttttgccatagcgaactgttgtgcggcctgttcatagtttttcgccgatgtttccagatcggacgggtcaacgcatatgcatgaggaagacactgccttcgctcctttcctgttcaacaagagaacgttttgttcaacgacgtgcggtcatgcgcatagcgcattccgcccatgcctcattcgccgggacgcctgcggtgacctgccatggccgccaacggcttgggctggaattcttcttcctcttcaatggtcggagcaatgtagcccaatgagttgcgcctcttatccttgctctgagacgcaccgccacgccccatacccatcattcccggagtgtttgcacgagatgacgccgcagcttcggcacgcgcaatttctcccttgcgcaatcccgcagccataccggttgcacctttgatcgacgaggatgcaatggacgccttgaccggattgttcgcataatacgaaccgacgccggagccagaaaccgctgccatggaagcttcagacagtgctccggaacttgaaccagctccacctgcgagcttggatacggctaacgctccaccggcaccgatgccagcgccagcgccagccgccaccgcagtacgcccgattccggaacccgatcccgcagagcctccggacatgccgccatgggcggaaccggaaccgttatagctcatatcgctatccacggccatgtggttccgatacacgtagcggcctgtcgccggatcgtatacgtataggttacggtcaagccaacgtccgcttgccggatcatacacgtatttgcttgtgtcgatccattcaccggtgttcgggtcaaacacccgaccattatggctattgttattgtcaccgcccgtatcggcagcgtccgtagggttgttacgtggaggaagaggcggcgtagggctcacgttgggccgggagattgaggccgaacctgatttgggggtattggagaatttcgatgatgcgacagccgcaccgccagcggccgcgagaccagcgccacctgctacggcagctgagattccagtgtcgccaaacgaggtgggatacacaccatcgttttccgaagaattgttttcaccatcctgtgctggccacaggccgttgatatcgacaacgggagcagacggtaaatcatttctaggacacttctgcttacattctgacttaattcgctggtattccttctttgcagtctcctctcgtttatcggcaagcatgtttgagatcaggctgacgccggcatttccaattatcccggttaatgttcctaatccgggaacgacaatattcaatggcgtttcagccgctttaatagcttgttcaatatcactggtcaacctagtgccgggcagctccacattcctcgcatcgtcgatcgcctgattgtatgcgtcaacagtcttaaatagtttacgcaaggctgttggtatgtccacatcctcaataccttcggaaattccttgagcgcattccaaagctaccttttgggtttcgcccccaaaaacataaccttcttcaagttcctttttcatggttttgagtttcgcggcggcatcatctatgactcgttcaaaccgtttgaaatcgtcaaattcctcaatagaccacttggcggtattggcgatatctgacagtttttcctcatatgtttccataaatcttcctctcgtgtcttcttacccgctatcgtttattgcctaggcggcaatggcggttgaggaacgtgctgaccgacctgcccgttcccagcctgcgttggagggtacgcgtatccggccggcgcaccggcgtccggatacgagccagcgacgggagcggaccgcgccgcgggaccgccatacgatggcgccacaccatacgggaccggcggaacaccggccccaccgacggttccaaccggcacggcacggcccgcatccctcgccctccgcatcctgcggaccagaaccaccgccagaaccacgccagccaacaccagcacaccggcacccgccagcaccacgggaaccacccacgacggcaccacggacgaacccgaagcatccgacgccatatccccggcgaccttcccatcctcctcatcggccgtggccgtcgaggaatacttcatgcaatcgctcccgccgtccgcacggcacgactccaccttctcccacgcggcctgctgacgctgcagctcacgacccaccaaggacgcctcgaccgtaaccgaaatcctctccccgttcggagagaacacgtcggtatccgctactccattcctccccaatggggatggatactcgtacatgcccttggtctcctcatgctccccgctggtcttcacggcccattccaggagcgggttcacatccgggtaccgggtcggatcgaccgacagcaacttgcctggatccacgatcccgaaaccacgcttgtgttccggatccagtttcggcccgcccgacgcgttgcccttcgtgttgcgaatcagggactgcaggatctggttgcccgtcgcatccggccaccgctgcatcacgagcgcgagatacgcgctcagattcgccgccgcggtcgacgtgccgccgccagtcaaatccatctcacgcgaatccgtgctccggtaggacggcacgcccacgcccggactcagcaccgacacgttcccgtccatcacatccgacgactcctgcagattccccgccgaatccaccgcgttcaccgtcaccacaccggggaaataatcagtcgtgcccggagcgcccaccagatcatataggccagcccaagagccattggacctacctgagaccatcaccacgccatggcgcagcgcatacaacatatagtctcggaaaatagcatcactgacatccccatacccgaacgacatattgatgatcctcgcgccggaatcaaccgcatcacgaacactcggacctattgtctgcacagtggattcgttattctgagttctgcaggcaagaggcatattaagctctcccagattgccctttgagtccgcgtccagcatataggcaatcacggaagccctagaagcgatgccttggataccggaaccaccatcccagccgctaccgttacccgcaatcagcgacaccatgtgagtgccatgcgtcatcatgtatccactggacgaaaggaccgttggatcatccgtggaaaccggctcggaggaaacggaaccatcaccggtttccagatagcagggctggccgccctcggtcaccagcttgtacgacacgtccgcgcccgccagcgcgggatagtcggacacaatctgattatcaagcacggcgaccttcacgcccttgccggtgatacccgacgcccatgcgtcgcgcacgcccataccatcgacacgccaatccacaccatccgaagccaccgccgacggcacacacaaccccacacaagccaacaccgccgccaacgccgacaccacgccgcgcacctttcgcacatgcgatgcacacaaatctcgcgtcatcaataaccccttctcgtatggaaataacaaacgcaacacgtcacttaatcagcaaattcaaagagtcttcggcggtagcggaggaatcgaaagcacattcaccacactatccactaatgacagcagcggctcaaacgcctcatcgctctcgttcttcttagaagtctcgtgtatgtcggatgctttaccctttgtttttccaacaacaggtgcagcctcctgaactgttacctcagccttatcgatagaagccacctgctgttcttcggcctgttcaaatattttcgcagcgctgcaaacgcgctgcgagaaactactcatggcttcgcctatattcgctccagttccctgtagcagctgggtatacgcggaagcgctcctcatgaattccttgccaaaagcagtatcgcggctatacgcttcctggccgcaacgccctgcagattcagaaaccgactcgccatatgaatccatgtcattcgctatcgcacgcgcattgtcaacatccgctttgatctcaactaccatacccgatccgctcctcgtcaacacccatattcccaaccggaaagattccgtgtgcgccccacacctttcgtggaacacacacggaatcgcacgacatcagaaacgacccgccgaacgcgcgtcagactccacgtactgctgtgcgatctgtgaggtggcttgggaaatctggccaagaatctgattcatttcctgcaacttgccatcccaattgcgttgcgcctgatgatatgcctcacgagcggaaccgtcccactgaccaatcaaagcgctcacctggctattgaggttttcaagctcctgagcaatgctcttggcatcggcagcgatatcgctcgccaaaacatccacctgctccggacgaaccgaaaaagaacttaccataatatgttttctcctttagctttctagttcaattcgatgatgtcagccaagcaacgcctgcaacttggacgtacgggactggttgtcttcctcattcgcagcctgatccttggctgtaccccgtaggttatccgaaagatcaatgagaatattgttcaaggacgtggccttctcctgccaactggacatcagcgcgttgaacgacacggccgcgtcaccactccagaaagagcccagctccgccatcttcgcttcgatatctttgattcggttctcgatacccgagcgcgcattgtcgaccgcagtggcacccttttcaattgccccttcttcggctctgatctgttccgccatcttgtttccttccttggaggcattctttcttagggaagccacaatgagacacgactcccccaaggaataacaataacagcaataacaaattcagtaaaatttaaattcattaagtatccaaaacccgagatgaactcacgtcaatcgtttgacgttaacttaaaagtcacttaggcatagcaattttactgaaaattaagcaattttttcagaaacaaatgacaatcactgcaaaaatgcaatcatttttctcaatgccttatagttgtattgtttatagacacgatacagcgccttacggcattctctaaggaagagcatgaacatctccccgccaccgctcccgcacggaagacaaaataccccatcttcaccccccatcaatacgacagatacactccaaatcaccgtctcctataaaacgcgcacaatcgcgctgcgggtgaacgacggccccatcatcgccgatcttctaccagacatagcccgacgactcggcatgctcgatccgtcgatcgtgtacggagggtacaggctgctcaccagcgacggcgatccactctcccccgcaaagactcttcgcgaacaacacgttccaaaccactccacgctcacgcttgagcccggagcatcatcagacaccgacatcatttacgatgacgtcgtagaggcagtaggcgccagcgtacagcacgtataccgcccttggaccagcgaccacaccacattcacgtcacttgtcatcggcctcggcatgcttgttatcagcgccggatggatcgcgcttttccccgcatccatatgggcatcggttctcgcatttggattcagcgcaatacttctagcgctcacagccgcattatgcggcaaaaacctgctcgtgcaatcaaccgcaatcggactcatcgccagcatttttactgcgattggcggatatcaactcgtcaacctgctcgcaggcaaacagccactgcatgccctgccacttcttggagcgagcctgggactcgccgccgcaggcatactcatgagtctcgccgcatccaaaacacgcccatacagttatattcccattttgataggtgccatctgcgccataccaagcgtcctcagcacactcatgccgcagcagatggggcatatctggatcctcacatcagccgtaaccgcactcaccgcgagcgccctgccttggatgtgtctgtcttttgcaagaatcagcgtagacagtccgcatagcgaatcggaaatcttcgcgcttcctaacgacattgactaccaagacatcaaacgtagatatatagcaggctcgaccatgctcttcatcggacgaatctgcgtcgccgcgctgctgctcatagcggcaccgctcctcaacacgttggacacgccactcgggtcagcattatgcctcgccgcattcctcggcatgctgctcgattccaggcagatctatacgttccgcgaaatgtgcgtaaccgtaggcgccgcaggcataggaatcatcgtgaccggatcgctcagcgtgcaaacgcatcaggaattcagcattccgctgattctactcatgctcgcatgcgccttcgcgggcatactgttcacctatgtcttacgcaagcatacgctattcgccacacgcgtggcggacgccgcagaaaccatatgcatcatgcttattttgccgctcgcatacctggcaatcacgctgtaaggacgctcatggccaacaagaaagaccttgccgaagctcaaaactactcgcgccgcagacttgtcaccgctttcagcagcggcattccagacggcgtggaactcactccgaagaaaaaccagactcccgtaatagtgggtgtagggcttaccgtcatagcaatacttgtcagccttttctacggcatggtaagtccatcattgccagacggttgggagaacaacaagctcatcgtcgcaaaaaactcagcggcacgatatgtcagttcaaatggaacgttgcaccccgtcatcaatgccatcagcgcacgactgctcattccgtcatccgacttcaaagtgctcacggtagccgacgaccagctcaaaaacattcccatcggttccaccataggcatcctcggcgcgccagattcgctaccggaagaaaacaatctcatcgcaggatccatcaatagctgcgtctccgacagcaacgtcacaaccacgctcagcaacgcttcgtctcaagtcacagacacggcaacggcaattgtcgccaatgtggacggcatcagctacctcgtcaacggaagtcaccgataccagcttcctcaggaagcaaccttacgagacgcgttcctcagagcattcggcattcccgaaaccgcttccaccgacgcaaccacacaatggatcaacctgttcgagcaaggaagcccgatcgaacaaatctcggtggacggagcaggcaacagcattaccgtccacggcgttgaagcgctggtcggcagcgtagtcatgcagcaaggcgatgccaagaaaaccaaatatgtggttcgttccgatggatcgctttccccactcaccgattttacctacggcctgtacatcacgggaaaaacggatgaattcacacagccgaacgttctcagcgcggccgacttccaattcttctcaaactccaccgaatccgcaattccggaagattggccctccgaagagctatcggcaacatccggaaacgtctccgcgtgcgcaatctacaatttggaaacggcaggaaggaaaaaagccgacacccatgtaaatttagcagtcaaacaaaacaactcagcacatagcggcacatccaaaacaaacccgtcaagcaataccagttcaacagtgaagctcaaaggcggcaccggagcattactgcaggcctccatcggcacatccgacaaaggctacattttcgccgtggattccacaggaaccgcgtatcccattgcgaatgccaacaaagaaaccctcaaacggcttggatacgccaaaaatgacgtgcaagccattccccgcgcatggatagacctatttagccaaggcgtcgaactatcagcccaagcagcaggatccgctccaggaagcaaccaatccagcgcatcgcaaacaaacgatggcggcaatgcgtcgtcatcaaccgccgatacgaccactgacgcagccactaacgcaacggatgatcctgaaacaggcgccgcatcggcagacgcgcaagcacaatgccaagccggcgtcgaaaactacatcaatgacactccctggaccaacacgctcttcgacttcgaaacactgcaccgtcaatccacgggcaaaggcgtaaccgtggcggtaatcgactccggggtagatgcggataatccacatttggcaaacgccgtaacacctggggtaagtcatatttcaggagacgccaccaacggcatgaccgacatatactcccacggaaccatcatcgcaggaatcatcgcggcgcgtgcagtagacgggtcgtccgtagaaggattcgccccagacgcgaccatactgccgatccgcatattcgaatcactccacgaagaaaacggaaagcaaaccggcggaccaagcatggaagacgtcagcaaagcggtaatcgaagccgtggaccatcatgcgcaaatcatcaatatttcattaagcgacatcaccgatcttcctcaaatgaggcgagccgtggattacgcagaatcacatggcagtctcatcatctccagcgcaggaaaccggctcacgtcagccagcaccaaggacggacgacgattccccgcagcctacagccaagtcgtaggagtcaccgccgtggatatagatttgaatatcaccgacgattccgtccacggcacccaagtggacatcgcggcccccggcgcatacgttgcctcaaccgtccccggcggcgtggactgcctttacgccaccgacgcagcctcaacaagcttcgcgaccgcatatgtaagcggcgcggcagccctcatcgcctcacaatatccgaatgaaacacccgcacaatggcggcaacgactgctcgtttcagcgaatcgaccaaattccgaccagcgagacaacaacattggatggggactggtggacccacaaaccgcgctgaacatagcgctttccgacagtcttcgaggcccgacttcaacaggtggcatgcacgcccagaataatgccgaaacgtccatgaaaccgcttgtattgcacaaaatccaagatcctgatacgaatttcaaacgattcgtggaagctgccagtatcgccgtgtcttgcgcgtatatggtggcatggcttgtacggaccgcgcgaaagaacacttcgcaaagtgtatcaacaaatgagcatagttttaactagaataattagatattttcagatagtcatttgaaattaatgccgatctgaacacttattcatagagaaacgaacggcatccgccttatgcagtccctcgcgaagtaatcactcgcccataggaaaagaagatcatattagcgtcccatggcgctgacgcccattcagctcgttttgccaccgtacgacagtccgccggaatacacccacatgccgtagtgtgcggcacgcggatcgttctccaacggaaaccgcgggtcgcactggtccggccagacgatgtcgtccatgcagggtgccgggatttcccgctgcagctgctcgtagtagacgcggtaggcgcggaacagctccagctccgtgtacggctccaaggcgcagtgcatggcgacatgcggttcgcggcccgcttgcagcattcggttgatccacgcgtacaggtaccccttgtagacgaagaatcccggcttgtgggggaacgtgttcatcaggtcgagcatacgtttcgaacatgaaccgttacgcaggtcggcgtatggcgtccatgccagctcgccgacgctgcatgcggcgtattggaacaggttcaggtcaacggtcaacgggaacggggcccttacggcgacccctcttagaccgaatcgtgaaatcatcggatccaccgatcggaaacgataccgtcccccatcggcgaactcgtcatagtacagaggctcgctgtccagaacgacgccatcccagccgtcgcgatgatgggcggaacgacagtagcagtgtttttcgtacagtccaccggtccagccgcgtatcggctcgttccagccgcccatgcacatgtagaccagccatctaggcaggggataataggagcccgtcgagccgacatcctccacccagccacgctcctcaagcgaatacgggtcgtccacctgacgccagccgaaaaaaccgtctcgttccgataccagagacatatttggctcccatctgcaaattagtgagaatggattcggcctgaccgttatggaaaccagcttttgtttgggatggcttgtttggaggcgaaccagcccggactggcagcgggataagccgcgccgccggtccggtcttgtaaggcaatatcacaagagtgatatcagatgcagttatcagaaatagctactaagaatagctaccggaagtggcatttagaaacggcatcagagggacgcgttgaaatcgcgcaccttgagcgtgcggtgcgacgattcgacattgccgcgcacaatacgctgcaacgcgttgtcggcgtccgcatgcgaagccagccaagcatcaccgagatccaccagcgtggccggatcggcatagctcggatacaggccttccagcagggcctcagccatgtggaaggtcttgttctgccaaatccagtcggcaacctcgaaatacttggccgcatacggttcagccaagtcggcacgtggagttgatgcgaagccgcgggctacggattccagctgcatgttggtcagctcgtcgttgtgcaaagcctcgttccaagcccattccttggcttccgcagtgcctgcgaccgcacgtgcacccaatgcgaactcacggttctcagtggtttcacgctttgcaagttccgcgtcgatgtcgctctggctgatggcgttgattgcgctcagcgcgttgatgatggtccagcggaagttgttgtcgatttccaagccgtcaagcttcacggaaccatcgagcagacccttcgcattcgcttcgaaagcggcgtcgcccggctcaccataacccaagtaggcggtgatcagctggaactgctcgtcggaaccggcttcggcggcctgagacagcttgaacagttcggcagccacatgctccaccacttcggcacggtcggccggagcggtgtaatgccatgcggtggtgctgatctgcgccagagcgtaacggaacgtggtggactcatgttccgtggcgagcgctgcaagcgaggtttcgatgaactgctttgccggcaattcgccgtctcgggtcatatcccagaatgcaagccaaatcacggaacgagccaacgcatcgtcgaaacgatacaggttctccgcagcgaacttgaggctcttctcatcgaaacgcagcttcgtgtatgtcagatcgtcgtcattcaccaaaatcaaagccggacgtgccttgccggcagccgcttcgacaatcgtcagctcgccgtcaacatcaagttcgaactggtcggtacgcacgatcttgccggtttccggatcctcattgtagaagccgacagccagacgatgtgcgcgcagcaccggatgctcagccgaagcggactgacgcaacgcaagctggcggatcgtaccatcctcgttttcctcaacttcggtggcgatggtgttgatgccggattgttcaagccactgggcgctccacgccttgagatcgcggccggacgtcaactcgagttcagccagcagatcggcgagcgtagcgttggagtacgcatgcttgttcagataattgttgatgcccttgaagaacttctcacgacccacatagaacacgagctgcttcaacacggaagcgcccttggcataggtgatgccgtcgaagttgacgtacgtgtcgttcagatcgttgatcggcgcgacgatcgggtgggtggtgctcagctggtcctggcgcagtgcccagctcttctcgccggagctgaatgtggcccaagcgtccttccattccgtggcttcggcagtggcgagagtggacgtgaactcggcgaaggattcgttgagccacaggtcgttccaccacttcatggtcacgtagtcgccgaaccacatgtgtgcaagctcgtgcagcacggtgacgacgcggcgctcggcatacgcgtcggtgaccttcgattcgaacacgtactggtcgcggatggtgaccatgccgatgttctccatagcgccggcgttgtattccggcacgtaaatctggtcgtacttggcgtacggatacggcacgccccaagtcttcgcataaaaggcgaaacccttcttggtgatgtcgaacaggtagtcgacatccttggcgaacgcttcggcgagcgcctgacggcagtacatggccatcggcacggtgcgaccgtcttcgttggcgtattcggtatgccattcggcgtacggtcctgcgcagatggcggtgaggtaggagctcatggtcggcgtggattcgaacacccacagcttggtggtttcggcttcgtgcgtgccgagcgtgccctcttcggtaacggtttcattgtcggtcacggatgcggcaggcatgttggaggtgacgatccacgacttggctgcaagcacggagaaatcgaacacggccttgatgtcgggctggtcgaacacggcatacacgcggcgggcatccggcacttcgaactgagagtacaggtagatgttgccgtcggaagggtcgacgctacggtgcaggccttcaccggtgttggaatactggcacagtgccttgacggtcacttcgttgtgcgcttcgaggttcttcagttcgatacggctgtcggcgaacgcttcggccggatcgagagtttcgccgttgagtacgatttcgctcacttcggtggcgatcaggtcaaggaagctggtagctcccggctcggcgtcgaacgtgatggtggtttcggaaccgaaattcttggctccacaggtcagatcaagtttgaccgtgtaatgaaccggtgctgcgataacgcttttgcgttcttccgcttcgattcgggtgagatttgctcctggcatgtcactccttatttgtgttgagattcctatttattgaataggagacggcgcaaccggttgtgccggttacgccgtccttcttttgattatgtaatcaacaattattgacgatctgtcgatatttcaatattattccaatattgatttcgctggaatcggcgatattgcgaaaaatattgactatctgtcgattcatcattgcgctgcgttcaatcccatcgcttcgtcaacatcctgtgcgatatcggcaacgaccggaacgatcatcggcttgcgatgcagctgacgtgcgacccagctacccaacgtacgacgcatgatctgctgcaacttgtatgtatcgtgcgtgccagccatcatcgcatcctgcaattgctcgacgatctgatgacgaaccttgtcgaattcgctttcgtcttcggccaccgcgttgagatagatcttcggacctgcgacaacgtcagccgtttccgtatcgacgacgacgaagctcgacacgaaaccttccgtgccaagaatacgacgcttctcaagctcgtcctcggtaagttcgccaacggaatcgccatcgacgtacacatagccgcatggcacggaaccgacaacagcagcttggccgtggtacaaatcgaccacatcgccgtcttcggcaagcaccacattctgcggatcgacgcccgtcttgaccgcgatcataccgttggccaccaagtgacggttctcgccgtggatcggcatggcgcacttcggcttgacgatgttgtacatgtacagcagttcgccctcattgcagtggccggacacatgcacggcggcattgtctcgattgaccacacgagcgccaagctgcaccagcttgttgatgatcttgtacacgccatgctcgttgcccggaatcagggagctcgcaagaatgacagtgtcgaattcgttgatggtgatgtcgcgatgattgccgtcggcgatacggccaagcgcggccatcggctcgccttgggaaccggtgcacatgtagacgagcttgtcgtcctgcacatcatgggccttcttcaggtcgatgaccgtgtcttccggaagtctcaagtagcccaaatccgcagcgatggacatgttgcgaaccatggaacggcccacgaacaccaccttgcgaccgtacttgtgggcggcgtcgacaacctgctgcacacggtgcacatggctggagaagctggccacgatgatcttgcgtgtggcctgggcgaacgcctgatccagcgccgggccaatggtggtttccggcttgacgaagcctggaacctcagcgttggtggaatccatcatcagcagatccacgcccttttcgccgagcttgccgaactccaccaaatcagtgatgcgatggtcaagcggcagctggtcaagcttgatatcgccggtatcgatgaggcttccggccggagtctgcacgaacacagccagagcgtccggaatggaatgcgtgacgttcacgaactcaagattgaacggaccgaccttcagcttgtcacgacccttgacctcaaccagtcgcggattgatgcgatgctccttgcacttggcttcaacgaaagccaacgtgagcttggaaccaatcagcggaatgtcggggcggagcttcagcagatacggcacgccgccgatatgatcctcgtggccgtgggtaagcaccagagcctcgaccttgtcgagacgatccttgatgtagtggaagtcaggcagaatcagatctacacccggctgctcctcttcggggaaaagcacaccgcagtcgatgagcagcaggtgaccgttgtattcgatcacgttcatgttacggccgatttcgcccaggccaccaagcggcacgatgcgcatggagcccttacggtacttcggcggagcgatcaacacgtcatcctgctggggcgcggtggtctgcggagcaagacgggaattgcgacggcttccagcagaagagcttgccgcgctggagttcttggaacctctggagttcttcgtgttctttgcggccttcacgtttttcgtgctcttcgagcccttggaggagccgctgccgttgccgcgagaaccgccacgaacggaaccggacgcatcgcccgcacgattgccacggccaccgccacggccagaagacttcgccttcttggaagtcgtttcagccttgctgaccttctcagagctcacagacttcacggattgcacatccgcggtctgcgtgttttcagtgcgcttggcagctttgctgccgcgcttgtgcgtagttactgttttggtttcttctatagccatttcctagttggatttctattactaattgtctccgcctgtgcggaaacgaggaattcagttagtttgccgtattacggcaaacccagcaaacttgtgatcgcaacaatgcccggaatcagcgcaatcgccgacaatcaagcgcttcgcaatcacaagtttcgcaatcacaagttcttcaattacagcaagccggaagcgcgcatgccatcttccgcgcgcttgatctcagcctcgcccggaccgacgttcggcagacgcatcgtcgtggagtcgagaatgccacgcaccttcagcgaagccttggccataacagcctggaaaccgttgccgttcattgcttcgaccagtggagcaagctgcacggcaatgcgctgagccccatgaatgtcaccgcggtcgaatgcggcagccaaatcgcgcatcggaccggaagcagcatgtgcgatcacggaaataatgccgactgcaccaaccgaaaggaacggcaggaacagaccgtcatcgcccgaataccaagtcaaaccggtttccatacgcttacgcacggcacccgcgatatctccggtggcgtccttgactgccttgacgtgaccgagctcagccaaacgacggtaggtttccaactgaatgtgcagaccggtgcggccaggcacatcgtaaacgataatcggcttgtccgcggaatcattgaccgccttgtagtgacggaacacgccttcctgcgacgggcgcgaatagtacggagcgaccacaagcaccgcatcggcgcccgcctcctgagtctgctccaccatgcgcacggtgtgggcggtatcgttggaacccgcaccggagataacgggcacgctcaccacatccttgacggcctgaaccagctcgaccttctcctccatgtgggtggtgggagactcgcccgtggtgccattgaccacaaggccatcggcgccatcggcaacaagctgcttcgcaagcttctgcgcggcctcgaaatcaacggaaccatcggccttcatgggggtgaccatggccggaagaatacgtccgaaaggagcaggatcaagaagatgcatagtaccgtcagtcatagtgccaacggtacttcccgccacggacgccgaagcgcccgagttcgcgaccatatcgcaatatgaactgccttccagagaccaaaatcccccacccgctggaacaatcctcccgttgccgagcctcccagagtcccgaaacctccagtcactggaacaatcggtacgctaaacaacccctcacattcccaaaacctccacccgctggaacaatcctcccgtcaaccagcctcccagagacccaaaacctccagttaatggaacaatcctcccgctgccaagcctcccacagtccaaaatcccccagcaagtggaagaatcggtacgcttagccgcatactcagggggattcaagccaaatgacttcacgattttgatctggtgaccgcacgatttcggaatatcgcacgattttgctttcctgaccgcacaacactccaaaacagtgcgatcaccaagagggaaaagtgcgcccaccaaaacaaactcaggcaaggtattgggtggggttttgctcaaacttggcggcgcagccagggttgcagaagtagtaggtggtgccgttgtattcgcgggttgctgcggcagtggccggatccacgctcatgccgcagaccggatctttggcgtgcgcgctctgattgccgttggcagcatggccgccacagcaagagcgcatgccttccatactctcgtgggcgttttccttcttggctttgtgatcactgaacagtcccatgatgaatcctttctgactgtggttgttgtgattattatcgttcgggttcggctgacgaacctgatacgtcttatttgcggcacgcaccgccttgtctggatcgaacaggcgcagtcggctcgcgttcgtcaccacgcatagcgacgagaacgccatggccgcgcccgcgatcatcggattgagcatcatgccggtgaacgggtacagtacgcccgccgcaatggaaatgccgacgctgttatagccgagcgcaaatccaagattctgcgcgatattgcgcatggtggcgcgggtcaagtcgagcgcatgcaccaaacccatcagcgagccattcatcaatgtcacgtctgcggattggatcgccacatccgtaccggtaccgatggcgaatcccacattcgcgcgggcaagcgccggagcatcgttgataccatcgccgaccatcgccaccgtatagccttgcgcctgcagtttcgcgatttcgtccgccttgttttccgggcgcactcccgcgatcacattgccaacgccaacttgatttgccacggcacgcgccgtcgtttcgttgtctccagtgagcatcaccacgttgacgccacgcgatttcaaagctgcgatggcctgctgcgaatcggctttcaccgtatccgcaacggccacgattcccgcaagctcgccgtcgattgctgcgagcatcggcgttttcccttccgccgatagccgttccatggttgcgataatgtcgtcaagatcctcgttgccgacactcggcatggccacgtcaagatcgtcgatcagatcggtattgccgaccgcaacgttgtacattgcggtttcgggagaagatatggataattcgaaggtcacggaagatgcagaggattcgtcggctgcaacagtcggattatttgcagatattaacggcaacgcgacgtgcgcagtgacgccccgaccggaaatcgcacggaattgcgtggtctcgcctaacgtaagatgcctctcttgcgcgcccgcaacaatcgcggcggcaagaggatgttcggaatcccgttcggcactggcggtaatcgccagcagatcatccggcattttgcgccattttccaagcggaaacacgtcggtcaacgatggctttccagcggtgatcgtgcctgttttgtcaagcacgacggcattgattttgccgcaggtttccaatgcttcggcggaacggatcagcacgcccatctgcgcggcacgaccagtcgaaaccgttacggaaagcggcgtggcaagacccaacgcgcacgggcatgcgatcagcagcaccgaaaccgcagccaccaacgcatgcaccacgcgtggttccggcccaaacgcaaaccacaacgcgcacgaccacacggcaatcagcaccacaatcggcacgaaaatgcctgaaatcttatccgccatgcgctgcaccggcgcttttgaactttgcgcggattgcaccaatccgataatctgcgcgagcaccgtgtctttgccgactttcgtggcacgataccgcagcgatccagtgccattgatggtggcgccggtcacggaactgccggcctgcttcaccacaggcatggattcgccggtaatcatagattcgtcaacagccgacgaaccagcaataaccacaccgtcaacaggaagttgttcgccggggcgaatcgcaataatatctccgaccgccacctgctcgaccggaatttcctcttcaatttcacctcgtaccacgcgagcgtttttcggctgcaatcccgccaacgcgcgcatggcctctccagtaccgacacgagcgcgcgcttcaagcaattggccgaccagcatcagcgtaataaccacaccaaccgcttcaaaatacggttcgcgagcattctcaggcagaatctgcggaataaacgtgaccacgcacgagtaggcaaacgcacatacggtacccagactgaccagcgcattcatttccggcgaacggtgaataatcgccgcgaaaccactgcggaaaatcggtaatgcggcatagcacatcaccggcagcatcagcacaaattgcacccaattcggcatcggatacagcatcaacatcgtcgaaccgaatactggaatcgtaacgatggctgacacaataagacgcgcaatcagcgttcgcatctcacgagattcggaagaatcgtttgacgaatcagaagaatctgaagaaatattggaagattcagcggattcatacgatttttcatcaacaacagtttgttgcgattgcatatgaacgtgagattcagcagtattcgtgctctcttccgattccgaatgttctttcggcattgcggcatgatgttttcccggcaccacccgtaatgtgccatgcagcatgttcatgccgcatgcgaaaccgtactcccccggttcgttagggtgaagcgtcaatgtcgttgtgcggaaagcgggcaatgccaggtcgacaccgaaatcggagaacaccacgtgcgacgagcattcaccgtcttctttgcgatcgaatatcaatcgcaatggcaaaccggcctcagcttcgatgattgccggactatacccacctttgacttcgacaaccgcctcttgcacgccgttatcgacacgagcgcgaaatgctttgcgcggcgcgaagaagaaccataacacggctgccgtcacaatgaacgcgacaatgacggcaatcaaagcctgcatattctcaccaacctcaacactaatagggttttattcacgttcacgtctcaatgactatcatcacaatatacccctatagggtatatttgcaagagaaaagcggtatcttcagcggtaagatcaagatttcagcgttacgaggaggagcatcatgaacgcaacccatcacggatacgcggacgaccagaagaaaatcatcgcacgcctcaaccgcattgaagggcaagtgcgaggcatacgccaaatgacggaaaacggcgaatactgcatcgacatcctgacgcagatatcagccgtgaacagtgcgttgaaatcggtagcgctgctgctcgtcgacgatcatctcaaccactgtgtcaaagaagccatcgaagagggcggggaagtttccgaagcgaaaatcgccgaggcaagcgcggccatagcacgcctcgtgaaatcgtagaccgcaaaacatgtcaatccccgatccagcaagcgaaaactcaccatcgccgccaaatcggggattgtatgatcagaccggaaaagttccagaccccatagatttacgaggtagatttacaggtcgaggaagttgtcgaggccgacggtcacgcctgggtatgcgccggtggagaccttgcgtacggccagcagcacgcccggcatgaaggagatgcggtcgaagctgtcggcacgaatggtcagctgctcgccgtcattaccgaacagggcctcctcatgggcgttaagaccgcgcagacgtacggcgtgcacgtgaatgccgtcaaccacctggccacgggagccgccatcggtttcggtggcatccggcacagggccaagacctgcggccttgcgggctgcggcgatgccctgcgcggtgtggaatgcggtgccggacggagcatccaccttgttcgggtgatgcagctcgatcacttcagcggattcgaagtacggagccgcaaccttggcgaaatagtcggcgagcacggcggaaatggcgaaattcggcgcaatgaacacactctggccctcgcgaggcgcggcagcgagcgcggcacgcacctgatcgagcttctcgtcggtccagccggtggtacccaccaccacgtcgacaccttgcgccacgagtgcgagcacattgtcaagagacacgctcggcacggtgaactccaccaccacgtcagtgttgccgggggtgatttgggtgaggtcgtcgccggcgtcaagcgcgagcgccaattcggtgtcggccgcgttgttcacggcatcgaccacatgggaacccatacgtcctttggcgccaactacagaaaccttgatcattgcagctccttcaagcatgtcgcacgtacgagcgtacgaacagcatttcaaatcagtctcactcattctactgaggaatgttccatttacgaatgtaaagagacgcttcgacgcgtcaccgcccagccgatcaaggcgaacggaatcgaagcgagcacgaaaatccatggcagcatcaggcttatgtctgggctgaaatggtcgagcatgattcccgtggtcatcgaaccgaatgacgcgccgatggttcccgcggtgctcacccacgcgaggccttcggtcagcgattcctccggcacggtctccttcataacgagattgcccgaagcgaacaccgacgaaacggtaagacccgtaaggatttcaaacactcccatcataatcagattgccttggcacatgtgaatgatgaagaagcctaccgttatgatcgcgaggaacgtgatcatatggcgccagcgggagcccttcagctcgcgcgtgccgaaaaccagcgcgcctatgcacgagccgaccgccaacatcgcaagctgcacaccaagcacggaatcaagatgcaacgctttcataacggccgtcatcgacgtatcgaatgcggtgaaactcatgttgaacacgatgaataccatcaaaagcggaatcacgcccgcataggtgagcacattgcgtttcttgcgattgtcattcgacttcaactgcgcgacggtcagtttgtcttgttgtttgtcttgttgcacggaatttgcgccgccattatttccagtattgccgtcaaccgccaatcgcacgtccgcatcgtcggaagatgccgaaacaacagtgatttcacgtactaccggcggttgcgtgtcacgcaatgcgaagaacaccgtgccgccgatcgcgcacgcaatcgtcggcacaaacaactgcgaaacgggatgcacggaagccgccaggaacgcggccagaatcggtccgaaaatgaatacgatctcatcgatggcggattccaatgcatacgcagtgttcagcaatgagccgttgccggtacggtcaagcacatacgtccaacgggtacgcacaagcgcgccgaacgagaattgcgtgagccccatcaccacagccaaggcgaacagcagtggaatcggcacgcgcaccaatgccgcgaacgcaaagccaagcatggcgatgatttgcacgacaagcactaccgatccgaccttgcgctggccgaatcggtcgaacagtcgtgcgtacagtggcgtgaccgccgccgtggaaagcacatatgccgcgctcatcacgcctgcgatcgtccaattgtcatacaaatggttgagtgcgaggataatgccaaggctcatcatcgacatcggcagtcgcgccaaggctccggaagcacagaacgctttggttcccggaatggagaacagtacggaatatggcgacttcgggatttcggttgcgctggtggcagccatgattatcgctccttaactttcgttgcgtccggcacgtgtgcccgcccacacatgctgcacgagggtagcggcgctcctccacaacgctgcccatagtgcgttaccctacgggcaggctggaaagcgccacacgttcggcgcaccagcactagtcgttgtcggattgttccggaattccgtagctcaactcggcaaggatctcttcttctgttttgtcggcggcattgagctgtcgatcgccctcaatgggttcactcagatagtagaggcaggcgtcgatagcggtgagcggtacgccctccattgccgacagcaagatacgatacatatccaactgtgctaattttttctgaatttcctcttttttgcgaggtttttttccagttttccaatcgacaatagtatattgtttcgaccgatccgccccatcgagacccccgaagaacaccgcgtcgagcttgccgttgacgatggtgcccaattgcggcacgttgacgacgatttgccgttccgcccacgcgggcttgcgccgtgcccatgtcgacgttgcgagacgctgttgccaatcgaatatcccgttattgtctgccccattatcgtcttgattgtcttgcgattgcgccgcattgttgcgtcgcagctcggcaagcatcgccaatcgcgattcagctacgcgagtaccgccattgccgctcgcgccaacgccaatgccggcatcattcgcatcggccatgatgaaccgttccgcccaagcatggaactgcgtgcccagttgcgcgaccggagacgctacgttcggtatcggacgcaccagcccacgccagtaagtgcgggcgccacgctcgtccatcatgcctgcgcgcgcctgcagcgaggtgacgttctgacgaccggatgcaagaatcctctcgcccttcgcacgcaccgcgctgtcgaacgcatcctgcgacgcctctccaagcatgtcaggcatgagattgctgtcggccaccagcaattgcgcgcatcgcagcagcgaagcacccgtattttcgcgacgcccagcaccttcgccaccgacaggctcgccaacttgcccgccggcccgttcgccagcccgcccatcagtctgcccgacagcattgttcatcgccgaatccacctgcaacgcagacaaacgcaacgtctgcagggtctcatcgctcaactcgcacggccatggcaggaactggttgccttccgacggctcgagcggcgcattccaagcgtcgccgaccaccgcatcttcaaaatcgcgggcatgctcgcccacaaaaaatccatccggcaacggcgcatcgatcgaatgcagactggtcatgccgttttcggaggaatcgacatcctcaacttccgcaatatcggccaggttgctcggctcagccgctctggaaacgatattgagcatggaatcgcgcacttccactaggaaattcgacggtttggacacacgtttgcgatcgcccacggcacgcggatcacggctttccgcattcgttgcgctgcaggtgagcagcgcctcatgacgggcgcgagtcaacgccacatacgcgaggcgacgctcgtcggcatgcaaccgacggccatactcctcgatttgcgtcaaatacagtccgtccggatcaataccttccatgtcatcgacgctcatattccgcaaggtgccgaacacttcgtcgtcaatgatttccgcatcctccagcatttccaacgcttccaacggatttccacccacaagcgcgtcatgggggaatcgcggcagaatatcggcgtccacacgcaccggaaccggcaccgcagcaggatcggtcagccacgttttggcggtctcatgatattcgggcggcgtccacacgccatcctggaaaccgttgagatgctcttcatcaacggccacacgcagatcgctgcccttgttggtggggaatccgccatcggtcatgccgaccacggccacggcatcccattcaaggcccttcgactggtgtacggtcatcagcaccacgtcgacaggcacatcgggagccaccgcgttctcctcgcgtgcgtcgcgcagcgaatccgcccatgagatgaacgcgcgcaggctcggcgttccctgcgacgcgatctcctgcatatacgtgtcgacgagcttcagcaacgcatcgatcggcgatttggcgagcgccacccgggatgcggcgagcgtggcatcggcctgaccgccgcgcatatgctcggccagctgcatgtcgatatcgagattcaatgcgacgatggcctcacgaaccacttccggcaacgggtggccaagcatgcgctgcacctgacggatcgcatccgcggcgcgaagcacttccttcgtcccttcacgactcaccctgccgtcaatgagttccgcgagatcgtcacgcaacatgaggtccacaaggaaaaccgcattcggcacttgatctcgatattcacgtacgatggcacggatttcagcatcggaaggacccgacttgggagttactccataaattcccagattttccggtttttcttccttgttggattgctcctgcacgattccagctgaaacaagcgcacgataccggcacatcgtgttcacctgttccgcggtatcggcgagcgcctgcagatcgttggcgctgatggagaatcgcggcgtggccagcaatcgcataagcgccgcactgtcggtatgatcgctgacgacgcgtagcaaagcgaacacgtcctgcaccgccgggcgttccagcaacgccgaccgccccactaccagcgtggtcaggcctgcgcgttcgagcgcttccgcgaattgcggcatgattcctttggaacggaacagcaccgccacgtgcggacgattgtctttcatgccattgtcgaggtcgcgcgaggaaggcgtatgcagggcgatcgcatgtttggcgaagcgcacgaccgcgtcgacctcctgcccgaacgtgtcgaacgcaagcacgcccaccgttccttcgggggcttcgtcggtattgacgagcgccggaacgtcgacttcgcgcatcagcgagctgctgaggcgtctggcaggcaagcggagcggtttggtgagattgttcgccgcttcgagcaccatgcgtgagttgcgccgcgtcacggtcaatgcgaatggcctgctggtggcgtccatgccgaaatcgtgttgcagcatgcggaatgcgccaggactcgcccctcgccatgcgtagatcgattggaaggggtcgccgaccgcgttgaccgcgctgcgatgcgtgtcgtcagcgtggaacagcgcgctcagcagtgccgcctgcgtggtggacgtgtcttggtattcgtcgaggagcacatgcgaatagcgtttgcggtaggccgctccgatggacgggaatcgggagacaagctggaatgccgcgatggtgaaatcgctgaattccgccatattgcaggcgcgtttttcggcatgatagtcaagcacaagatcgagcagcaggtcgcgttgcttggcgacgaatgcgagttgcgcgctgttgaacacgcacatgtcgtgcccgagttcgcggtatttctccagtttcttttcgtagtccgcgtcggaatcctttttcagtcgtttcggcagctttggcgatttcggctcttccgttggcacggtttcgccgtcaagcgccttggcgatctgttcgacgaacgcctcatcccagtcgcgcacgcgttgcacggcttcgtcgaagctggtgcagtcgccgccgatcatggcgccggaaatggcgttggacagggcgaacacgttgcccgctatggtgttgaacgatttcagatcgccgtcgaacgccataagatcatccatatgcctgtcaagcacagtgtggatgagctgcatggcacctgcttcgctcaatggctgcgtgttctggtcaaagccgacaagcagtccatattggcgcacgatggattggaagaaagcgtcgtacgtggagacttccggtttgaggaacgtcatgttcgctgatttcaggccgcgttcgcgctggtcgcgagtcacggccgcagacactcgagacaatagttccgaggccgctttgcgcgtgaaggtcagtccgaggatcttttcggggctcaccccctgttcgatcagcgtgatgatgcgtctggtcatcgtgtaggttttgccggagccagcgccggccaccaccaccacatccgcatacgagggcgcttggacgacggcagcctgctcaggactgtcggtgaacttcatggttccgctcatgccgttctcctttcgaatacggtgttctgttcgcccgcacaggccgggcagatcgtagtgtttctgcagtatctcacatgttccgtcgtcggtcttgcggtgatttcgttcgccctgctggccgcggccgcatagaagaccctcgcgatcatggtgagggaccataccgccatcgtgccgcgtaagccaaggaactcattccaatgctcgtcgctcacttccaacggaggaagcatgtcatcgagtccgtcgtggaaatccttgtcgagttttttgacgtaatagcgcggtatgaattcgccggtattgagacttccattggcgaacagcgcctgctgcatatgcgattcggcggcggtgtcgccatgcggcgcagggtatgcgtgcttggctacatggaatagcgcgctttgcgtgatgttcggcgcgttctccaccgcctgcgccccgcgcatgccgctttcctcggggaatacgagtcccagctgatagcagacgagctgcagatcgttgaacaggccttcgccggtcggactgacaccggttttgtagtcgatcagacgcacctgctgcgtgccatccgccatttcacgccgttccaaacggtcgatcctgccggtcaaacgcacggtgagatactcgctcatgccggtttccggccatcctccgaccaacgctcccataatggcgatcaattcgttccgtgaaatcgcgtgaacgccgtccatcgcattgtaggcgtcgagaatatcgtcgaaatcgaattttgcggtaaatttcagctcaggttcggctttcgtaagttttccaacgctgaatgcatcattatttttaatcggataatcaccatgattcgattgcacgaaatacgtggcgatgttacgcaacgcctcctgcgcctgctcatctttcttcaacgcctgataccgttgcgcgggatcggcaatggcgttgaaatcaccgcatagacgcttgtattcggcatacatccattcggtgatcgcattgatattgtccacgtcgctgatggcggtatggtgttccggcatatcaagtccggcttcggtggcctgttgcgccaccttgtggatcagcgagccgaaactcgtggcgacgctgcccatgcgcgggccggagaagcggttttccaacatccaacacaccgggcacgcccacagattgtctaccgcagaaggagacaaagtcaccacgtcggatcgccgcgatttaccgtttcggcccgacgtcgagctttccgacgtgtcgctcatgcccgtccgcatgacggccgcgatcttccgcatggtggcctcgaccgtctcccccataaacggccaacggtcagggtcggccgccgtaacaccatgcgaagccagcaatgccaacgcttccgcggcatcacgcgccttcgggctgtcctcaggttccgacgcaagcacgcttcgggcggccgcgaccagaccacggggatcggtttccagccccgcgtaatcgccttggccgccgaccgacgcatattctcgccgttccatatcggcgtcgcgatcgcggtcgaagcactccggcatatatccgtatagaaaatccgaaggcacattgtcgtcattcagcacggcgctcaccaccacacgctcgctggcacgggtcaacgccaccaacaggctcttctgctcggaggcgagcaccgacgccagttgcgcgtcctgcctgcccgccggagtgacgatcgtgtcggacaatacgccgtgcagcatcacatcggccagttcctcaccgccgaacaacgtgttgcgtggtgtgagattcggccactgcccctgctgcaaagccggcagaaaaaccagattccagcgctttcccgccgctcctgcgggagtcgtcagggtcaccgcctgatcaatgggcgcggtatgcgccagcgaatccgcctcaatggtcagcaaacgcacctgttcgatgaacgcctcgatggtgtgtaccgcgaattccccgcttgactcgccgcctgaagcatagttgaacaaacgcatcgccgcgtcaagccgatcattcgcggcacggccggcagccgaatgctccagcgccacacgctgccagacttccgccttgccgcaggccctccatgcgcaatccaacacatattgcggttcacgcgaaaccagtttggcttccgactcgcatgttttgtcaagaaccttccacaatgatgcgaacgccttgatctgcggatccgcgcccagcacggaggcgatcgcatcgaccacgcgatcggtattgccctccataagaagcacgtacagcgcttccatactcagcgcgaaatcgccttcatgctcgtcttcatgctcactatcatgctcgccatcggcgcgaatcgcatgatagtccgtcatataatcgcgccaatcttccatcaaacgagggagcaacgcctgttgttcgacggcagcgtccgccgcatcctcatcatcttcgaaatcatcttcaaagtaatcttcgaaatcatcttcgtcgtattcttcggcagcatcctcatcatggttcgcagccttgctttccacaatcgaagcgagcgaaaccaacgcgttcatcgcggattcgatggatgcgagacgggccggacgcccctcatgccgttgatcaccaccgaccgtaatcagcggagatcccataatcaacgccacgcgcgaacgaatataggatccggcggtctgcaggtccatggtcgaagccgcgatcgtctggtttttcaattcggccaactcgatcaacgcgaacagaccctgcacgaacggctcatccttcaacggccgggtcacgctggaatagcgcacgggaacgccgtcagcgcgcaaccgctcgccgaatacgcgcacggtggcattgtcgtgcgcgatcacggccatgtcgttccatacacgggaacgttgcaaatgctcagttttgatcttccacaccacgtcgtcgagctcttcggaagaggaacggtacaaggccgtttccacgctgccgtcggccggcgtgacacgagcgcccgtatcgtcggccggcaacgtttcgatgggcatcgcgcctggcatatcgctcattttgccgggacgatcgggcagaggcacgtccgtcgactccgtgcttgcgatcgacaggctcactcgcgtcgcgacaagcgtgcgatagtcgccatgcacgccttgctggttcgacacggtttgcgcggtatcgccttcgtgcgccgtttgcagaccttcgatgcgttcaagcctcgctcccatgcgcgtctgcgcctggttgaacagatattccggatatgatcctcggaacgtctgcacggcttcgtcgggattgccaaccaacagcaggcgcaccccgcgttcatgcagggcttcaagcagtgcgaaaccagccaacgtcgtatcttgaaaatcgtcgacgatcagcatgttcgcaatatcggcttcctgtatgccagacacggcttcggtggcgtcgatcatcagctgcgacgcgtcgagacgatattcgccaggataagacgaacggatcgcctcattgtattcctcacgcaaggcgaaggcgagacgccattgagtgcgcaggcgttcgcgacgttcgtcaagcatgccgtccctgctggccgcacgggcgatcagcatgtcttcgaactgcggtttcgcgccaatctcgttcatgcgtgcgagcatgtcgcgcaattggttggcgaatgcgtcggtggaatcgtcggccaccagtcctgaccattcggaaaccgcgaaataggtgcgcagcagatcgcaggtggcgcaatcgtcgccatgttgcctatgctccacatgcgaagccagtaccttgcggatgatcacatcctgttccgcaccgttcaacagtttcggcaacggttcgccttgacttgatctcacggccgtcagcagacggaatgcgacggcaggcaacgtagtgaccggtcgcgcctgcgacacggccgacaattcgcggatcgcccgatcgcccaacgcatcggcgatctgcctgccagacaccgtcatcacggcattcccgtcaccataccgcctcattgcggcaaccagcatgcccagcgcaaactcggtttttccactgctcggcgcgcccgcaaccaacgtgacgcggtcaaggtcttccaaattcatcatgcctcccaacactactagtctcgccctcctttacctgacaaatccggaacctacaaagttgtctcgaagccaacctttatccaacacaatctgcggtgcaaccactccttcgtggcatctgcagcaacgccgacaacacatcaatggtcatttccatttgagccagatgcccgtcatccagcaactgaatgtatgtaccctcatcgtcgccacgaaggccgtctcttaaggttcgcacgttctttctatcactacgacttctattattcagccacaacatgtctcagatgcccgtctttgtatatggacattttgaccccttgctgataggtttctgtgttggtcttcagttaggataggatccagagagagcggccgaaaagcatacgcaccacgaggaaagagagcatatggaagccatgaacggcattccccctcaaatccctgggtatacattcgcccaaaagttgggttcaggttccgaagcgaacgtgtatttgtaccagcagctttcccccagccgacaagtggccatcaaggtcagcaagggaacgctcgatccgcgcgcggcggcgcggttccgttccgaagcgaacttcatgggcaggatctcctcgcatccctacattctttcggtgtacgaaagcggcgtcaccaccacgggcaacggctacaccgtgttcgaatacgctccgggaggcaattacaagaccttcctggaatccaacaggctcaacgcagaccagatgctcaccgtcggcatcaatctggcgagcgccctttccacagcgcaccgcgaaggcatcatccaccgcgacatcaagcccagcaatattctcatcaacacgcatggcatgcccatgctttccgatttcggcatcgcgggaacgatctacgggcgtcccggcatcggctacaccatcgcgtgggctccgccggaagtgctcgcaaagaacggcggaggcaacgaatcctccgatatttattcgctgggagcaacgctgttcgccatgctgacgggccagtcgccatatgaatacggctattccgcggccctcggctcgaccaggggcaaagaacgcggcgctctgctgagaaacatcattctcaccgatccgctccctaagctcaataggccggatattcccccgcaagtggagcggattttatgcaaggcgttgaataaaacgccggaagacagatattattcctcatacgatttcgcgcgtgacatgcagcgtgcgcagcaggaattgtatggccatgccacgccgaccacggtcgaaggcgaaccgccgttcccgcaaaatctgtacgcacagtcccaggcaagcagccaggcaaccgcggttgttccgaaacagcgcaacacttgggccaagcctcttgcgattgtcgtttcggcggttgccgcgatcacggccgtcgcgttggtgttcgcgtatgtgatcttgccgaatatggattcggcttccgacaatagcagcgtgcagatcaagactccgggaacgcacgatcaggacaacgattcgcctgattcggccatcaccacaagtagcgtgcccagtgtcgagaatctggccggctcatattccgccgatggcagcagcgtgcagttcacatgggtgaaccccgaccctcaggacggcgattcatacgtatggtcgatggtcggcgatgcaggagtagacccgaacgcccaaggaaccaccaccaccgacacgcacatcagcatcaaacccgccgacggctcgcagacctgcattcaggtgagtctcatccgagccgaccgtcagatgtcgcagaatcctgcgatcgcgtgcgcggccaaaccataagcatcacagcacttcccaacagggtcggccgacggcattattccatcgcaggcgatgtccggaacgaacacaacgaccatcggaacactcaaggaagaaccgaaaatggacaaacgcaagaacgcagccgatcagccggcacaatcgcacgaacgtcaattgcgcttcggatcgatgatgcgcaaactgctgttgccgtcgggaagcaggcggtggatcacgccgatcgtcatgctgcttctgctgctgggcatcatcgcaggcgcgttcatcgtcagttcggtgacgcaacggcatgtgcagctcgacgacggcaccgtgtggatcacgtcgctgaaggaccgcaaagccgcacgattcaatgcgaaaaacaaggatgtggacgccggagtctcatccgcagcctcccgtttcgacgtggcccaacataatggcagcaccgtgatttccgaaggcaccaaagccagcaatatcgcggcttccaccatcagcgaaaccggcaacaccgccatcaaaacggatatcgaaaccattatcggaggcgacaccgcagtgttcatcaacgtcaaaaccggcaatgtgtgggtgggatccgctaccgatgtgaaatccgtcaattcaatcaccgacaagccgaacatgaaactgggatccggtggaaaaatcgcggtgacgcacaacggaaccgtatacggataccgcgcttccgatggtgcggtgctgagcatcgacgggccgcaagacacgcgcgagcaagttggcacgataggaggcgccccgcatgccgaatcgttcaccgtcatcggcgaaaccccggtcgtggcggcaaaaggcaccgtgtattggccgcagggaagcgcagccatcaatctgcagggcagcatgaccttgcaggccccttccacggacggcaaacagaacggatgggtggccgtggcgacaccacgcgggctcgcaacggtgaacctcagcaccaagaaaacctctgaaacaccgaattccggcaagggcgagcccgcccagccggtatccacaggcggatgcgtattcgccgcatgggcgcagaaagccaacaattacgccaaagtatgctccgtcgacagttcggacatgacattcgacaccctgaccaacatcaacgccacttcggaactgatattccgcaccaaccatcgtctggtcatactcaacgacgtggtcaacggcaacgtctggaatccgcaggaatccaccaaagtcatcaaaatccaatggaacaaggtggaaaccaaacagtcgaagcaacaggaacagaacaacgacagcgccaacaaccagcataatttcagcaagacctgctcgtcgcaatccggccagatcaaagccgaagatgattcgttcggcgcgagaacaggatcgcagcagatcctcgacgtgctccgcaacgacgaacagaccgactgctccgtactgcgcatcacctcggtaagcgcccccgacggtgccaacatcagcgtttcccccgtatacgacggacgatatctgcagctcgacgcttccgcggcatccgaaggatccgtatcgttcagctatgaaatctccgacggacgcgggcaaacctccaacgccaacgtaagcctcacactggtaggcggggacgacaacgcgccccagcaaaccgatacgccaccggaaatcgacgtggaacaaggagcgacctacaccaccaacgcgctgggcagcttctccgatcccgacggcgacccgctcaccctcgtatccgcaaccccgcaaaacaccgaccaggtgaccgtttccacacgcgccgacgggcagctcgtgttcaacgcgggatccatgtcttccggacgcgccggcatcgaagtgaccgtttccgacggccagcagaccggcaccggcatggtgtatttctcagtgaaaccggccaacacgctggccgcggtgatcgatccggccgtcaagcagaccacgccagacacccgcaccaccatcgcgctcaaacaatacgtgcatggcacctcggccgaacccgcgcagctgaccgccgtggaaaccccatccggcgcatccaccaccatgaacgccaccgatatgtcgttcaccttcagcgcatccaaccccggcacctactacgtgccctacaccatcacacaaggatccatcccctcgaccggcctggcccgcatcgaagtgcaggcggtgaccggagactccgccaagcccatcgcagccaacgacgtggcactgctcggcgccgacaacaccgcaatcgtggaaccactgtctaacgacgtcgacccgatgggtggtgtgctatccgtgaccagcgtgaccgccgatgcggcgagcggcatcaaaaccggcgtcgtaagcaacaagcgcgtctacatcaccgcacggcaggtaccgaccgagcccgtgcagatcacatacagcgtcgccaacgcggcaggcacgtcaaccggcgtgatcgtactgcagccaccggcactgaccacctccaactccgtgccgaaagccgacaacatcaccacgcaggtacgcaccgacggcatcgtctccatcgacgtgctcgaccacgtgacctactccgacggcaccacggtaagcctgcaaaacgacctgcaatacgacaaaaacacgttcaaaggactcgtattcgtatcaggcaacaccgtacgataccaagcatccaaccaaaccggatccttccccgtaacgtacaccgtcaaagacaatctcggcaacgcggcatccgccacaatcaccatcaacgtgcatcaaaaagacgcttccaacaaggctgcgccaacaccatccgacgtcgaggcgcaagtcgcggccggccaaaaagtccagatcccgatcaccttgaccggcatcgacgccgacggcgacgacgtgcagctgctcggtctcggcaacaaggcgccgacactcggacgcatcagcgaagtcggcgccacctacctggtatacgaagcctatgccgactccacaggaacggacaccttctcatacgccgtcgaagactggaccggccaacgatcccaagcgcaaatccgcgtaggcgtattcacatccggcaccgactcgggcgtatacgcgcgcgacgacgaaatcacattgcgccccaacaccgcagcaaccgtgcccgtggcgcaaaacgacatctccggagacaacaccgacctggccgtcagcgaaaacgtcgaatcgcaagacatcagcaatgtgaccgtggcggacaatacgctcgccttcaccactcctcagcaggcgggcacctattacgtggtgtatacggtcaaagacaaggcaggattgtccgacaccgcgacattgacggtgaacgtggacgacaacgccaccatcgaaccgccgacagcatacgactaccgtgtgccatcttccgcgacgatcgataagaaatccatcgacgtggacgtttcgcaatggatcgcgaacccttccggcagcgccgacgaactgcaggtggccgttgatgattcggctaccgaccatgcgcatatcaaaggcggagacaagtccacgaccattaccgtggacttgacggacgaggcgcgagccgtgccgtacaccgtgaccaacacgacgtataacatcacgtccacggcgttcatccaagtgcccgcatacggcgtgttcccgccggtacttcgaccgaaagcgccggctttgaaggtgaacgcgcacgagacgatcaccatcaatatcgccgattacgtgcgtgtgggcgcaggcaagaccgcgtatgtggacggcgccgattcggtgagcgccacgaaggccgcggacggcgacctgtatgtgaacgaccagacgttgaagttcaccgcatcaaaggattattccggtcccgcgtccatcaccttcaccgcggtggatggcaagcgcgacaagaacgacaaggtgaaaatcatcaattcggcggtattgacgttgccgatcaccgtgatcgggcgcgacgtgcccgcgccgacgttctcttcgcccaccattgacgtggtcgcaggagaaagcgccaccaccatcgatctgaccgcattgacccattcggcgtccgacctgtacgacgatgaaaagcagtacacgtattcgggtggcgctgattccgaccaggtgagcgccaaagtgagttcgaacggcaagctgaccgtgtccgccgacaagaccgcttcgccgggaacaacggtgagcgtgccgatttcgattcaatattcgaagggcacggtgagtgcgggcgtcacggttcgcgtgacggcctccaacaggcctttggcacgcatcaacgcgaaaaccgtgaaggtcaaggcaggatccagtgaggaagtgaacctgctgtccgatgcgtataatccgttccccgattccgcattgaccgtgaccggatgcacgtccgatggcgcgtcgaagctgaccgtggactgcccgtccaacggtgtggtgtcgatcagcgcctcgtccgatatcggcgcgagcaccaacaaggtgatcgtcaacgtgcgcgatgccaccaatacgaaggaacgtgaggtgacgggcaccatcaacgtttcggtgatggacaagccggatgcgccgctgctctcccccatcgccggagacccgcaggatggcgcggtgaatctgagttggacggccggctcttcgaacggcagtccgatcagcgaatacaaggtgtcgtggggcggtgacggttccggcgagaaatcgtgcggatccgtgacctcctgccaaatcaccggcttgaagaacggcaagacgtactcgttcaaggtgcaggccaagaatgaggtcggctggtcgaaggagtcgaatggcgtggaaggcacgcctgacaagcttccggacgcgccgaccgatgtgaaggccgaagctagcaagaacaccatcactgtcacatggaaggctttggagggtaatttctccgccgtcgacaagtatcaggtgacgttgagcggtccgaatgtggcgaatccggcccaggaagtcactggcaccagcatcacgttcaaattcgacgacaatgcgatcaccgacggcgcatcctataccgccacggtcaaggcgcataacaaagtgaactggagccagccctccacggcatccaatgccgtttcgccttggggtacgcctgacaatccgactatttccgccgatcaatcaggcgacaagatcgtggtgagaggacggatcaatgacgcacgtaactcgaaataccagtcgattacggtaagcatcgagggcgaagacaaatccgtggagacaagcgccaaggattattccgtcgaattcgacattaagaacgagtggtactacagaaaacttaagccgacgattaccgtggttacggaacgcagtggctcattgcgcaacgaagcgtccgtttcgactttcacagcagtcgatcctccaaccaatgtgaagctggaactcaacaacaacacatgtgtggcgacctggtccagaaaaggtggacgcgtcacaggtttcgttgtaaaggccaagggttattacgatgatgatgttcatgagagcagagccgaatggccgctttccggtgattggagcacctgcgatacggtaagcgtgcaacagtacttcatcgacacctcacatctcagcgacccagcaatcgctaccgataataccgtcggcaacaaaaagccagcggaaatcacactgccatcctcattgacgtgggatacacagaacgccaacatcattcatgtcaatggcggtagttgggaggcccacgggcgaagtgtcaaaggccagatcgtcatcactccggcaggggaaagctcgcatacctacgattggccagctaacggcacactggatgtttccgacatcaccagtccttccggtaccagatgcgattgggaggttcgcgtgatcaccactgccggggaaccagaaatcaatgcgaccaagaaaagctctgatcccgtgaccggagtccgatacgaggagaaaacccccgatccggaaccgggaccaacccctgataatggagagacgcaatcctcgatagacaccaatgcttcagccatctcattacgaacagggttggcaggaaaacaggcgcgaggcatctcattcaccgtcaaataagcaaattcaacatcacaaccaatcatcaatacgatcaatagaagcaaccaaggagtacctatgagcaacgaaaacgacgacgccacccagctgggttccattgggcgccatatgagcaagccgcaacagcccggcaatccgcaggcacgccccgcattccaagctccaagcctgccgacgcatccgcaggaacaggacggagacgaagagggcacggtactcagcacgcataacgctacccactacgccgccaacacgttcgacgccgacgaggagggcacggtactcagcacgcataacgcaactccttccaggccgacgaggcctacggttccaatggcgcagcccgtgcaggcgcaaccgacgcaatccgctccaacacaacagccgctaccacaatcgcaatcggctcccgtaatggcaacgcgccaattcccgcagactacggcaccaagcgtcaagcccgcgcagccggccatggcttcttccatgatgtccgcgccgcaggccgacatcaccgaattccatgaactgttcgcccaactggtcggcaacgtctcccaagtcgtggtcggcaaggaacagccgatccgccaatgcgccaccgccatgatcgtcggtggccacattctgctcgaagacaatccggggaccggcaaaacgcagctggcccgcggcctcgccaactccatcgacatgtcgttcaaacgtatccagttcactccggatctgctgccgtccgacgtggtcggcgtaacctactacgaccagaagaacggcgaattcgaataccgcgaaggtccgattttcgcatccatcgtgctcgccgacgaaatcaaccgagcctcgccaaaaacgcagtccgcactgctcgaggtcatggaagagcagaaagtcaccgtcgacggcgaaacccatgcggtaccgcagccgttcatggtcatcgccactcagaaccccatcgagcagctcggcacctacaaactgcctgaggcgcagatggaccgtttcctcatcaaaacaaccatcggctatccgagccatgacgtaagcgtgaacatcctcaagcaggtcaacgtcaccgaccgtgcctccaccgtacatgcggtgctcaccggcaacgacgtgctgcgcatgcgcgccatcagcgaaaccgtgcgtctcgacgacgcgatcatcgaatacatcgtgcgcttggtggaagcgacgcgccacaacgaacgcatccaagtcggatcgtccatgcgaggcgcgctcgcactgacccgatgcgcccgcgtgtgggccgcgtccagcaatcgcggatacgtggtgcccgacgatgtgaagcaactggccgtcgccgtgctcgcacaccgcatcacgctcaccgcggaggccacattcgcgggatccacccccgaacagatgatcgaacagatcctcaatgaagtgccttcaccgaccgtgggcgccaccgcctgaaacgcacggcgcagccagccgcgtacgacacggcacacgcgaagcgcacaccccacacgaaacgttcgtaaagccccgaaaggtcaagcatgcgacaatccaaaaccatgcagcgcaggagaaccatgcaacgatccctacgacgcatcaagcatcgcatcaaacgactggtcacctcatacgtgtcgccgctcggatgggccgtgaccggactcgccatcgcctcactcatagcgttcacaatcctcagctggcatgaactgctgaccatggcgatcgtgttcgcatgcatgatggtcgccgccatcatgctgtcgctcggcaacacgtcgttcaccgccaccatagacgtgtccagcaggcgcgtcaccgtgtcagacacggtgaaagtcgatgtgtgcgtcgacaatccagggcgcacgccaaccacatcagcacgcggcgacctgcccatcggagacagccacgaacgattcgccatccccatgctcgccgccggccaatcacgccaaaccaccgtggaattcaccgccgtctcccgcgcggtactgccggtcggtcccctgtccatacgcaaaggcgacccattcggactcgtacgacacgaaaagaaacttgtcgaccaaatcaacgtgttcatccacccgaaaaccgttatgctgaacacactcaacgccggaattccgcgagatctcgaaggccagccaagcggcgaaatcgtcgacgacgacctcgatttctacggactgcgtgaatacgagccaggcgacgacgtacgcaacgtgcactggctcagctccgcaaaaacaggcgcactgatgatccgtcaatacgaggcgacccgacgcaccgacaccgcattgaccatcagcgtgaaccccgacgactatgtgagctccgacgaattcgaactggcggtatccgtccatgcctccatcggcgtgcaatgcctgctccaaaaccgaccggtgacctcacacgcgggaaccgaacgcatcatgccacgcaactccacggaattccttgacggctgcagcgccatctcccccgatatcagcgacaatccgaatctggcgcaaaccaccctcgcccatgcccccgactcatcgttctactacatcaccgtcggcaggctcaaaaacatcgacgaaatcaaacacatggcgctcgcactcccccgatccgcaacctgcgtggtactgcaaaccgccatcggacagccacgcgccatcaaacgatacgccgatttcaccctggcgaccgtaggaaacctagacgatctcccaatgatcatgggggtactggaatgagcaccacaggactttccatccacaacaccaacaccggcgacaccggccgcaccaccggattcggcaacaccttcaccggaaccggcaccggctcatgggccgactccacacactccgtcatctggatgtcacgagacggcaaatcacaggcactcccctacctacgccggacacgcgcctcgcaatacgcaagcctgctcgtcgcagccctactcaccctcgccgccgccagcaacctcatcgacgtctacggatcggccacatcctgggcgctcgccgccattccggccaccatcatcggatctctcgtggcgctcgcaggcacggttccggcacttcgtctctggtggcagatgctgttcatggccgtcgcccagctggttgtcggccctgtactgttcctcaacgacaccaccatcgcccatattgttccgaccttgcgcacgcttacacaaggctggatgaacatgctcggatcgttcaaattcattctgtcggtcgaacctcctaccggtaccgccgatggctgtttgctggccgtatggaccatctgcctgtggttcgcgctactgaccggcattttcgcagtgactgaagatgggcgattcaccatgatcgccattattcccgttaccgccaatcttgcgatttgcgcgctgctcggctcatcttccggctattaccgcatgttcgtaggcaccataatggcgctcatattggtgatttggatcagcgcacgttggaaattactggaattgggacgttggctcagttccatcgtgatcgtggtgctttccgtcgcattggcgattggaggatgcctcgtcgtcgatcaggaccgcaccattctgcgcgaccattatgatccgccgcttagcccgtacaattacaccagtccgttaagcggcatgcgctcgtacattacaaacagtaaggacgatgtgctcctcaccgtcgaaaacctgcccgctggatcaagcgtgcgactagcggtcatggaccgtttcgacggcaacgtatggaatctgtccgactccaccatgtcatcggactcctccaattaccgacgtgtcggcacctccatcaccaacaatgccgaaggcaagaaattcaccgccacattcaccgtggacaaaggactcagcgactactggctgcccatggccggagccgcatccagcgtgacattcgacaacagcgaaaactccgactcgttctactacaacagcgacaccatgtcggccatctacccctcacgcacctccgaaggtctcacctacacggaaaccggcatcatgccaacggttcccaccgacaaacagatcgccaaaacagacgcggccgccatcagccagccaaaagccgaagatgtgcccgactgcgtagacaaactcgccacagccatcgccggaggccaatccaaaggcggcgaagcggcccaggccttagccgaaaagctcaaagaatccggttggttctcacacggattaagcggcgactacccgtcaaccgcaggccacggcaactaccgcatcgaccaactgctcgccggaacggccatggtcggagacagtgaacaatacgcctccgccatggcattgatggcacgcagcctaggtcttcccagccgtgtggtactcggattcctgccaaaagacgacgaaggtgaaatcagcgaaagccgcaccgaagaacaaggaacaaccaccatcacgaaattcaccggcaacgacgtgaccgcatgggtggaaatcaaactggacggctacggttgggtggcattctatccaacgccaaaggaaaccaaagtccccgacgaaaaccagaacctcaccccaccgaatccgcaaaccctggtacgccagcccccggtaccactcaccgacccgctacgcgacgacacccaggccaaaggcaagtcctcaatcggcggaagcatggccgacgaaacctcagccaacctgttctggcagcatttcggcagaatcgcaagaaaagtagccatctacggaagccctctatggacgctgctcatcatatgcggtctcctgctcgccatcaaagcgatcgcactggcacgatcaagaaaacacggcagcacgcagcagcgtgtggcagccggctggcaatcggtcgccgcgctcgcacggcaaagcggactcgacattcgaggcacacgcagcgaacaggcggtttcgatcgcgaatcagatggatatttcccgcgagaccttgctcgctttgggcgcgcaagccgattacgcggccttctccggtaatttcgtcaacgaagagcatgtgcagcagtattggcgcgatattgcgcaggaacgcaagtacatgctcaagtcattgccgacgttacgccgatggcgtgccaaactttcgcttgccgacgttttccacttccgcagcaaccgcagcgggcggaacaacggcagcgatcggaagcacaatcgtaagaaaggacgggactcatgatcttccgtagcatcgaggccggcctgaatagcaatgtcgggtgcaaaagaaaaaacaaccaagacaacgctctcgccagccgtggcgtatatgtcgtatgcgatggcatgggcggcggcaaaggcggcgagcgggccagcgcacaagtggcggcatgtttctcgcagcttgccgaacagccgtcgcgcaaccgtacgtccatcgaacatgcgttgagccaatcgcagcaacaggtgctcgaacttggccaggagcttggcggcatcgccggaaccaccatcaccggcgtggtgctgccgactcgcgttgaagatagcgtgcatgaacaagccatcgatgagtactgctacgtcatcaatgtcggagattcacgcacctaccatatgcgcgccgatgcggaaggccattggatggcggagtcgctgacccggatcacacgtgaccattccgaacggcagaacgccatcgacaccggcgaaatgctaccggacgaggcgaaccgatgcataccgcgcaatatcatcacccaatgcgtcggcgctcctgacggcattcagccggactggtatgcggcgcgctccacgggacgtttcatcatctgctcggatggcctgcacgcgcagatcgatcgggaactgctcgccgatgtggcggccgcatatggcgatccgcaagtcgccgcggatatgctggtgcagtccgcgctcgacgcgggcggcaacgacaacgtcaccgtgattgtgcttgatatatgcggcaaatcatcggattattcggcaaatgacgattggaacgtcagcaaaatcgacgatcacgaggatatcggcgatttacaggaaagcacattgcaaacgttacgtgccgtccaataatgcgcatgttcccgcaatgacaatcgtcaataatcggatttgtcacgttatatcagcgtattcaatacaatatttacagaacacgagataaggagatcatgatggtcgatttcgatgccgcggtggcggccgtgcaggatccgaacgcagatcccgtgtttctggcgaaaatcgcttacgaaaatccggaattcggcgcgaatgtggttgccaatccgcgtgcgtacccaggcctgaagcgttgggtcgcccagttcggcgacgaacgcgcacgacagcagctggtcgcgatggggtggccggttccacaggacggaatcatgcagcaggaggccgagacggcttctgaacagacgcaataccagatgccaagcgaacaggcgcaataccagcagccgcagcaatcatcggaagtgcaatatcaggcgcagcaccagccgccggcaacccagcaatgccagcctgagccgtttgcggcaacacctgcatcgaatatggcgaacgatgcttcgacggaatacgtcgacccatataccaaccccgcagacctgtctgaagtggctgatttttcgccgattcagccgcaagagccagtcgcgtcgaatgctggtttcaccgcagaattggccatgaccacggaagatcagatgctgatggctgaaatcgcaagcaaagctccggagctgcaccccttccttgcgcgcaatccgcatatctacccggatctgctcaactggcttgccagtctcaatgattccgccatcaacgcagccatccgtctgcgacggtaacccttggtagaacttggcaaaagcccgacgaaagccgccaaacaaggcctaataaggcctaataaaagccgcttgcattggtaagctttcgtaccataatatgttcgttgcgccgtcatcctcatttatggattgacgacgcaacatgtatcgcggcgcgaaggaaatcagcgctgttcgaaagtgaagaactggtctccgatacgcaccgtgcaaggcgcgtcaagcttcatcggcttgcgttcgaccttgatctcctcattgccttgaatgatgtacgtgccgttgagcgaaccgtaatcctcgatccacaatacgccatcctgatcgaagctgatcgccgcatgattgcgtgagatggtgcgcgtcggatcctccaacttcacgaatttcgcaccttccggcacttcagcggaaggcttgcgtcccagcagcacacccatatcgacgatcacttcctggccggtctgctcgttgtaaagcacatactccagcttcggctgcttcatggtgaacgccgaagacagcaccgtgccatcccagtcgatgtcatcatcgtcattgaccggttcgacgtcggacggttccagcgctgcggcagcctgttccaccggctgtatgttcgccgcatacgattccgcggattcctgcacattttccaatgcttggaatgcttgggattccggtgattcgtatgttggctgcgatgttggctgcgactgcgcagcctccgccatggcgggctcaacgagagaagacattactgtggcatcatcgtcataccaacctggttcaggtggaggcggatatggaagaaagctcataccttcattgtaatttgccatgcgattttgcgatgaagatatccgctctgcaatacgtacggttccgcaataggctgactgttgtcgtagggatcgcagcaactgcagttccgcattaaaaatagttccgcattaaaaaaatggggatcagctgtttccagccaatccccattcatgtattgagatgatttcagacgttatgccattccatcatcgcttttcggatcatagggtgtcgcccaaatccatctgaccgccattgtcgtccaggaagtcatccggattgaagtcgtcgccgagcttcagatctccgaagtcgatgttcgagaagtcgacttcggacagatcggcgtcgccgaaggcggcatcggactcgtcgccacccaaaccgaagttcgggtagatggtgtcgcgaatggccttgtcaggctcgaccacggcgttacggtaacgggcaaggccggtacctgccgggatgagcttaccgatgatgacgttctccttgaggcccttgaggtcatcgaccttctggctcagagcggcttcggtaagcacgcgggtggtctcctggaaggaagccgcggacagccaggaatcggttgccagcgaggccttggtgatgcccatcagctccggacgaccggcagcaggcttgccaccttccttcacggccttcatattggcgaccttgaagcgggcctgatccaccagttcacccggaagaaggtcggtatcgccggaatcgatcaccgtgatacgacgcagcatctggtgcacgatgacctcgatgtgcttatcgtggatatccacgccctgggagcggtacacggtgtgcacttcctccacaatgttcacctgggcagcacgcgggccgaggatgcgcaggatcttcttaggatcgacggagccttcgatcagctgggtgccggcttcgacatgatcgccgtccttgaccatcatcggggcgcgacgggtcaccgggtaggcgatcggctcgacggaatcgtcgtccggcttcaggatgacctgacggccgcgctcggtgtcttccaccttgaccacgccagcgaactctgcgatcggggcctcacccttcggagtacgggcttcgaaaagctcggtaacacgagggagaccctgggtgatatcggatgcggaagcaacgccaccggagtggaaggaacgcagcgtcagctgggtaccaggctcgccgatggactgtgcggccacgatgccaacggcctcgccgacatccaccagcttgttggtggccagcgaccagccatagcacttggcgcacacgccgcgcttggattcgcaggtaagcacggaacgggccttgacctcttccacgtcgtgggcaacaagatcgttgagcacgtccatggacagcgcgtcaccggccttgtacagcacggtctcgccgtcggcgggatcgatcacgtcggttgcgagcagacgggagtacggaccgccatcggcggccttgaccagatgcaggttgccttcagcatcacgctcgccgaccttcatcgtcaggccacgcttggtgccgcaatcctcttcgcgcacgattacgtcctgggaaacgtccaccagacgacgggtcaggtagccagactctgcggtacgcagtgcggtatcggccagacccttacgtgcaccgtgctgggagatgaagtattccagcacggacaggccgtcacggtagttggacttcaccggtcgaggaatgatctcgcccttcgggttagccacgaggcctcgcatgcctgcgatctggttgatctgcatcatgtttcctcgtgcaccggactgcacgatgatagccaggttgttcttggagtcgaagtgttcctcgaccgcctcagaaacctcgctggtgcacttggtccacaggtcgatgagttcctgacggcgctcctcttcggtgagcataccgatttcgtagttctcgttgaccttgtcggcttcggcttcgtacttctcgatgtactcgtcgcgctcggacggctggataacgtcggagaacgcgaaggacacaccggaccacggtgcgcgggtgaagcccatatccttcagcgcgtccagcgttgccgccacctgtgcggtggagtaacgggttgcgatgtcgtcgacgatcttgctcagacgcttcttcggagcctgatcgttcacgaacgggtaatccaccggcagcgtgctgttgaacagaatacggccataggaggttgcgaaaagcacggaaccatcatggaagcgctcttccttcaccacggccgggctgcccggttccggatcgacgacttcgatttcgctcggctcccagcccttcggcagcacaaagtcttccggaaggcggataagcaccttggcctgcatgtcgatctcatgcttgtcgagggccatttcggcctcttccagcgaggagaacacgcggccctggcccttggcaccgtcgatgacggtggtcaggtagtacagaccgaggatcatatcctggctcggcatggtcacggtgtggccgtcagccggcttcagaatattgtcggaagccatcatcagggagcgtgcttcagcctgggcttcagcggacagcggcaggtggactgccatctgatcgccatcgaagtcggcgttgaatgcggcgcaggcaagcggcggcaggtggatggccttgccttccaccagaatcggctcgaatgcctgaatacccagacggtgcaacgtaggtgcacggttcaggagcaccggatgctcggcgatgacctcttcgagcacgccccacacttcggagtcgccgcggtccacgagacgcttggcgctcttcatgttctgggcatagttgaggtcgacaaggcgcttgatgacgaacggcttgaacagctcgagggccatcggcttcggcagaccgcactggtgcatgcgcagggacggaccgaccacgatcacggaacggccggaataatccacacgcttaccgagcaggttctgacggaaacgaccctgcttacccttgagcatgtcgctcagggacttcagcggacggttcgaagcgccggtgaccgggcggccacgacgaccgttgtcgaacagggaatcgacggcttcctgcagcatgcgcttctcgttgttgagcatgatttcaggagcgccgagctcgatcagtcgcttcagacggttgttacggttgatcacacgacggtagaggtcgttgagatcggaagtggcgaaacggccaccgtcgagctgcaccatcgggcgcagatccggcggaataaccggaatcacgtcgagcaccatggcctccggcttgttaccggtggtcaggaaggcgttgacgaccttcagacgcttcagggcgcgggccttgcgctggccggtaccggtgtcgatttcctcgcgcagctgcttggaagcggcttcaagatcgaagtcctgcaggcgcttcttaatggcttcggcgcccatgcagccttcgaagtaatcgccgtagcggtcttccatctcacgccacaggtcgacgtcgccttccatgtcgcccggcttcaggttcttgaagcggtcgaacacggcgctcagacgctggatctgctcgtcgaaacgaacgcggatggcggccatttcacgctcggcgctgttgcgcagcttggcgcgtgcggagcccttggcttcgccttcggcctcaagttcagccagatcggcttcgaccttcttggcacgctcttcgatttccgcgttgcggcgcttctccaagttggcgatatcgttgtcgaactcgtcctgcagacccggaagatcctcatgacgctgttcctcatcgacgctggtgaccatgtaggcggcgaagtagatgaccttttccagatccttcggagcgatgtccagcaggtagcccaaacgggacggaacacccttgaagaaccagatgtgggtcaccggagcggcaagctcgatatggcccatgcgctcacgacgaacacggctcttggtgacttccacaccgcagcgttcgcagacgatgcccttgaagcgcacgcgcttgtacttgccgcaggcgcattcccagtcgcgggtaggtccgaagatctgctcgccgaacaggccgtctttctccggtttcagggtacggtagttgatggtttcaggcttcttgacctcaccgtggctccagttacggatatcgtcggcggtggccaggccaatcctcagtttgtcaaatgcgttgacgtccagcactctattgtcctgtctatcgattcttaatgcttaatcacgtttcatcaggctggtcgcgccgcgctgtcaggcaacgcgaccagccttgggatcactggaattcaggttcttccacaacctggtcttccttggcggccgcgtcaggacgtgcgccaatgttgaagcccaaatcgtcggaggaagtagacggatcatcgtcctcgtccttcatgtcaatggccacgccttcggcgttgagcacttcgacgttcagcgacagggactgcatttccttaagcagcaccttgaaggattccggaatgcctgccggcggcaggttgtcgcccttcacgatggcgccgtagacacgcacgcggccgtcgacgtcatcggacttggtggtcatcatttcatgcagcgtgtaggcggcgccataggcctcgagggcccacacttccatctcgccgaaacgctggccaccgaactgagccttaccgcccaacggctgctgggtgatcatggagtacgggccagtggaacgcgcgtggatcttgtcgtcgaccaggtggtgcagcttcagcatgtacatgtagccaacggagatcggcttcggatacggttcgccggtacggccgtcgaacagcacagccttgccgtcgtcgccgaccagcttgttgccgtcgcgatccggaagggtgcaggacagcaggcccttgatggtttccggacgaacgccgtcgaacaccggagttgccaccggagtgcccggctcgcccttttcggcgccctgcggaatgtacttcttccaagcggcttcggcatccggatcaagggagatgtcccagccggcgtgcgcgatccagcccaagtgcagttccagcacctggccaaggttcattcgagaaggcacgcccagcgggttcagcatgatgtcgaccggagtaccgtcggcaaggaacggcatatcctcttccggcagaatgcgggagataacacccttgttgccgtggcggccagacagcttgtcgccctgggtgatcttacgatgctgcgcgatgtagacgcggatcatctggttcacgccgttcggcagctcgtcgccgtcttcctcggcatcctcgcgagtgatctccttgacggcgatcacagtaccggtttcgccgtgaggcacgcgcagcgaggtgtcacgcacctcgcggctcttctcgccgaagatggcgcggagcagacgctcttccggagtcagctcggtctcgcccttcggggtgaccttgcccaccagaatgtcgccggcttcgacctcggcaccgatgcgaatgatgccacgctcgtcgaggttggccaccgcgtcctcgccgacgttcggcagatcgcgggtgatctcttcggcacccagcttggtttcacgggcgtcgatctcatattcctcgatgtggatggagctcagggtgtcgtcctgcacgagacgctgggagatgatcacagcatcctcgtagttgtagccgttccacggcatgaaggcgatgagcaggttcttgcccaatgccatttcgcccttctgggtggccggaccatcggcaagcacggtaccggcttccacacgttcgccgtcgtgaatcagcggaacctggttgtagcaggtggtctggttggaacgcaggaacttggccagcttgtaggagctggtggtgccgtcgtcgttcatcacacggatgatgtcggcggaaacatacgtcaccacacccggcttctcagccagaatgacatcgccggaatcgacggccgcacgccattcggcaccggtgcccaccagcgggcgctcggattcgatcagcggcactgcctgacgctgcatgttggtacccatcagcgctcggtggccctcatcgtgctccaggaacggaatcagtgaggcgccgacggaaaccatctgacgcggggaaacgtccatgtagtcaacggagctgacgggcacatcgactgcttcctcttcgccgactcgggcaagagcctgcttcttgacgaagttgccgttctcgtcgagttcctggttggcctgtgcgatcacgtgctcggcatcgcggtctgcggtcatgtattcgacctcgtcggtcacatggccgttgatgaccttacggtacggggtctcgatgaagccgaacggattgatgcggccgaaggttgccagagaaccgataagaccgatgttcggaccttcaggagattcgatcgggcacatacggccgaagtgggacgggtgcacgtctcgcacttccatggatgcgcggtcacgagacagaccgccagggcccagagcggacagacgacgcttgttggtgacgcctgccaacgggttgttctgatccatgaactgcgacagctgggaagttccgaagaactccttgatggtggcgttcaccggacgaatgttgatcagggactgcggggtgatggcctccggatcctgggtggtcatacgttcgcggaccacacgctccatacggctcagaccggtacgcagctggttctggatcagttcgccgacctgacggatacgacggttgccgaaatgatcgatatcgtcgacgtccacgcgcagatccacatcctggccgtcacgcttgcccgggaacttggtgtcgccggcatgcagggtgaccaggtacttgatggtggagatgatgtcttcgcgagacaggctgcgatcgttgacatccttttccagaccaagcttgcggttgatcttgtaacggccaacgcgggccagatcgtaacgcttggtgttgaagtagaaggaatccagcaggttgcggccagcttccggcgtcggggtgtcggccgggcggatcttgcggtacagatcggtcagagcctcgtcctgggtctgcacggtctccttggcaagcgcgtccataaccagcgggtaatccctgaacgcatcggcgatctcatccttggtcatgccgatggccatgaggaacacgatggcggactgcttgcgcttgcggtccacgcgcacgccaagcacgtcacgcttgtcgatctcgaactcaagccatgcgccacggctcgggatgatcttcgcgccgaagacttccttgtcggaagtgcgatcctggctgcggtcgaagtacacgcccggagaacgcaccagctgagacacgatcactcgctcggtaccaccgatgatgaaggtgccgtgcggggtctgcagcgggaaatcgcccatgaacacggtctgggacttgatttcgccggtgtcgccgttttcgaattcagcgttcacatacagcggcgcggagtaggtgtaatccttctccttgcactcctgcacggtgtggcgcggttcttcgaaatacggatcggagaaggtcaggctcatggtctgagcgaagttctcgatcggtgagatctcctggaagacctcatcaagaccggaggtgtggggcacggtgttggtgccgttcgccagatcctcctcgacacgcttctgccagcgctcgttgccgatgagccagtcgaagctgtcagtctgtacacccaacaggtagggtacatcaatgggctcgcggatggagccgaagttcacacggtccgacgccttgtgcagatcaatatcgtgctggtcggcgcgtgcgatgatggtggtggtgttcgtcgtagcctcagccaatggacgttccttatcgctcgctaaatcgtttcgatatgtttccccggaagcgctcccattggccaccatatgcctagtacgcgggcgcttcttccttgtcagcgtgcccgctatatgacacgcatgtacgcaaagtcatgagaataacatatcctatagatttttattcaatagtgacgccgaccggatcggacttcgctttgggatgcccttcaatcgaaagctgcgccgaatacacgccacgatccaccttcggcagggtggattgatcctccacgcattcgctgccagtacgcgttcccggccaggtgatcgtctgtctgacctcgtcgcccttcgccaacagacgatagtcggtgtcaacggggcacacattcgacttccaaaccacatcatcgcccgatttgatcgtcaacaccacgctggaagccgacacatcaaccaagcaaccaaccttgctggaaccgtcatatttgacgtccgtagtgaaatccatcgaatcgcccacaccgaaacttgacgccgcaggagtcaacgaaagcgcgacattggacgcatcgcaatccggcaccccgcttttcttctccttggtcggggacggcacttccttacgggaaatcgcatacacgtccgcatgatgaatctcacgattcaccgcgacaatccccctcgacagggagtacaggcaaaacaccagaaaagaaatcagcactatcgcagcgatgccgacgacgatgcgacggcgacgaaatatcgcctgctgttttttcgaacgtttcttgccggatttcgaggacgtcttctgtgccatgatttcacagtctagcgtgcgcacatccaaagaacgtcggcattcttcctttcataccggaagacgcacatccgcattcggcaggatttcgataagaccatcctcatccaacgatgcgatgcaccgatcaagctggatatggtcatcccacagtcgttcaagcgacttgcgattaagggcggtcgcaccttccggcagattgcgcagcgcattcagcaccagcccacgcacctgacgatccgtaccttggaaacgttgacgcggccgcgtgcgacgttcccccaatcccggacgaccattatgcaaaaacacgcaatgtcccgaaacagggcacgcctcgcacaacggagcctttgccgtgcagacggtcgcgcccaattccataacggactgattccacaccactgaaggacggtcgaaccgtctgcattttgaggcatcatcctgcggcaacatctgcttcgccaacgcacgttccgcaggtcttgcggcgccgccaagcgactcctcgccaagaaaaaccctcgaaagcaccctgcgaatattcgtatccaccaccgcgatgcgctcaccaaacgcgaaactcatcaccgcgctggccgtataatcgccgatacccggcaatgccagcaactcatcgtacgtacgcggcagcttgttatcgtaatcggaagcgaccacgcgggcgcattcctgcaatcgcaaggcgcgtctcggatagccgagcctgccccaagccgtgatcacatccgctttcgcggcatcggcaagcgcgaccgcatcaggccagcgttccatccaatcgttccaatacggtaccacacggctcatctgcgtctgctggctcatcacttcggagacaagcacgccccacgcagtagtgcggccgaaacgccatggcaggtcacgcgccgaagcatgccaccattcggcaagcgcgtccgccacagcttcggcgttttcaatttcggtattaggctcgttcgtgtcgttcatcgtacctattcttgcattcatgacgaacgaagagcataccaatgacgcgcaaggcgcaaccgcagaggaagccaaagtcgagaaaatgttcgaatacggctaccgcaagtcgaattatgggccggacgaactcgtgaccgacgcgcacggcaatccgatttccgtggtcgacgcgatgctgtcagccgaagacgcggccaaagccgaaacctccacgccccacttgtgctactactccccccgcattccgggcaataccggttcggcaatccgcctgtgcgcggtgaccggcacgatcctgcatttggtggagccgcttggattcaatcttcgagatacgaagctgcgccgcgccggactggactaccacgacatggcgcacgtggtattgcacccgaattttgagaatctggtggaatccatgccgaattcgcgcatcatcgcgttcaccgcgcacgccaccaaactgtataccgacatcgaatacaagccgactgacattctgctgttcggcccggagccgggcaatattcccgatccgatggatattatggccggtccgcacgtggccgaacaggtgcgtctgccgatgcgtccaagcctgcgttccctgaacctcaccaactgcgcatccatcgccatctacgaagcctggcgccaactaggcttcgccggcggccagtgatccctcccctgcctgccaactttcgtttcaattcattaccttatggatattggggacgcagtagggcgggatattccattcgtgacacactcaaggccgttcagccaagcctacggtcccgaacggaatatcccgccctactgcttgctatggcacacaaaccaacgtgttgcaaacaaaaagcaagcgtcaacctaatctgatgtgaagcgcaacataagcggggagccggcatgttctgtttcagaccgtaaagacttggcctgagcggcccggagcgtgtcgggaatagaatatgccggctccccgcgaccttccgcaaccaacgcaaccactgcgaaagatgcgtagggaagagaggggctagtttttgaagctgtggattggggcggggatgcggccgcctcgggtcacgaaagcttcgcagctggtctggttgactggaatgatcggcgcatagcccatcaggccgccgaagttggccatctcccctacgcctttgccttcgaccggaatcacgcgcacggccgtggtcttctggttgaccatgccgatcgcagcctcgtcggcgatgatgccggaaatggtggatgcggtggtgtctcccggaatggcgatcatgtcgaggccgacggagcacacgcaggtcatggcctcaagcttttcgatcttcaggcagccattggttgccgcgtcgatcatgttcttgtcttcggagacggggatgaacgcgccggaaagtccgccgacgtaggaggacgccatgatgccgcccttcttcacctgatcgttgagcatggcgagcgccgcggtggtgcctggtgcgccaacctgttcgaggccgatcttctcaagcacttcgccgacggagtcgcctacggccggggttggcgcgagggaaaggtcgatgatgccgaatggaatgccgaggcgacgggctgcctcctgtgccaccagctggccgacgcgtgtgatcttgaacgcggtgcgcttgatggtttcgcacaggaattcgaagtccttgcccttggcttcgtcgagcgcgcgggaaaccacgccggggccggaaacgccgacgttgatgaccgcgtcgccttcggtcacaccatggaagccgcctgccatgaacggattgtcgtcgggggcattgcagaatgccacgaatttcacgcatccgtaggaatcgttatctgcggtggcgtgcgcgatgtctttgatgatgtggccgagcagttcgacggagttcatgtcgatgccggttttggtggatcccacgttgacggacgagcagacaatgtcggtttcactcagcgctttcggcagggagcggatgagcagctcttcggccggggtcatggacttggatacgagcgcggagtagccgccgatcaggtcgacgccgaccttcttcgccgcatggtcaagcgcatgtgcgattttcacgaaatcgtccgacgttttgcatgagcttgctccgaccagggaaatcggggtgacggtaatgcgcttattgacgatcggaatgccgtagtcgcgttcgatggctttgccggtggatacgagatccttggcatacgtggtgattttgttgtagatgttgtcgcagacttcgtcgacgctgtcggccgcgcagtccagcaggctgatgcccatggtgatggtgcgcacgtcgagcttctcctgctcgatcatctggttggtctcgtggacctccatgatattcagcatggtttttccttacgattagtacgattcgtggcttcgattacttgcgtgactcacgtatgccgcggatcagacgcggtgcatcttggtaaagatctcctcgcgctggcagcggatgcgcacgccgatctcctcgccaagcttgtcgagatcgtccacgacctcgccgaattccttgtcggcgttggaataatccacgatcatcatcatgttgaagaaaccgtcgatgatggtctgggaaatgtcaagcacgttgacctgatgttcggaaaggtatgtgcagacgcgtgcgatgatgccgacagtatcctgaccgacgacggtgatgattgccttgttcatggaactccctaaacgttaggtgcgaatatccagttgccgtctcggcgaattgccggacgtgccctcaagtatagggaaggcacgtgccaaaacacgtgccttccatctatttgccttacatactgagatgactgccggttaccacctgccgctgtagcagctgtatgtcaccgccagatgccgtcgagcacacgcacatccacgcaatcgaccttgccgtcggcaacaaaacggaactcgccatcgccgtccgcgccttggaacagcatgctgccggccgcttcgccgttgttaaggaagacttccaccacattgcggtcgaagaagatttcgacgcgacgcacgtcggtgatgccgctatcgaaatcaacgttgtccacgactgttcccttcgtgaccagtcgggtcacgccgttgcgacgctgcagctgcaattccatcgaattaccattggcgggattggtaccggtcgcgatgagcattgtgaaatcgttatcgtcggccagatgcatgtccatgtaatacgcgttgttcggcacaatgaagaaggtcccgttttcgtctgcatgagcttccaaacgatcgcctagcagctgctcgtacgcttccttgacaggacgactggtcaaacggccgtcacgcacgtgcagttcacgtggcagcgacatcatgccgttggcgatacacggcttttccacacgcatcgcgggaaagtcggtataccagccgaacacgatacgacgcccgtcgtcggcaaagctttgcgtggcatagtagccggtaccgaaatcacaccaatcactgttctctacctgcaaacgtggaccttcggcggtgtccttgagatcaccaacataccaacgcacctgctggaaacgaccttgcttgtcacggtagtgcatcaacgcgccgatggcgactgtcttgccgtcgagctggaacaggtcaggacattcgtaggtacgcgatagctggtggccgaaatcggcgagcaccggtccttcatactgccacgtcacgttgcgcttgagtggtttcttcgcggagaagagcgccatggcaggcaccgtatccatattgggcttgtcggtgccgggcctgccttgcggaccgcacgtgaaccagccgtctgtgccctggacgctgataccgggcgccgcggaggacacagcatcagtatcgaattcggagaccggcagattcgtggcggtcaccatgtaagcgcgttccggattgatagcctcgccggacatgccggtttccaccttcggatcacggaaatcgaagccaaaaccatcgttaacgcgcaacgcgaccggagattcgacactcacatgcacgccatcctcacacaagcaggtggtttggtattcagtaacagacgattcgtctccgcgagtctccaggtgccgggtcaggtacaggcgaatagcggccgcatcatcacccttgcagggattatcacacgcatccaccgtcaccgctgatccggagaacgcgccaccaacgatgcgttcgtcgatatgcagctccggctgcggttcgaggaagattggcagatgcgtccaatgcaccagatcgcggcttaccgcatggccccagtgcatattgtcccagccaaaaccatacggattgaattggtagaacagatggtagcgtccttggaaacgacacaggccgttaggatcattcatccagcgagcgaatggctcgaaatgcgccgcaggacgagtgaaacgatcatagatctgctccagcgtcggctgcgtatcccattcattgtcgtacggattcatgctgatgaaacgcacgccttcatcaaggagattctcacactcggacaagtaggcgaaccgtacggtcagtcggtgcgcactcaccgtaatacgcacgttcgtcggcaccggaatcaagaaatggtggcgacgctcggccaccggcatggcatggctggcgatttgatggccgtccccgtctgtaatggtgacggcagcgtcatcgccgcatctttcggcgaacaattccagcaaacggtagctgccggtttcgatggcaacggaatagttgtcaggcataataatctcctccacagcgccacatgatcagatatcatgtggctacgcattgaaaaacagataattagaaaaacaaatggaaaaaggaaacgtccgtcacgacacgatggaatcgcgttcgatgatgcggcagcgcaatgctgttttgctgccatcacgttgcctctgcaccgccatgccacgatcggactcaagatcggctacggccttgtcgccgtcaagtatggtgacaagttgccgaaccgcttcaaaacccatctcataatggggtagttccagcgtagtcagtgatggtttgatcacattagtgatgaacggctggttatcgatgctgatcaccgacacgtcagcgccgatgcgcactccgcgttcgcgtgcggcttcgtagatgaaagtggcgcgcacatcgttgaaacaaaagatgccgtccggcttgatttcgtcgaacacccgcgccgcttcatcgtccgcgttagtaaattccaatacttcgacgaccaaagcgtcatcgaatggaatgcccgcttccgcaagcgcacgtcggtaaccagtcagacgttgctcttgcgcgacgatggatgttgcggaaccgtagtagacgatgcgtctgcatccagcttggatcagacggttggtggcgtcataccccgccagttcatcatcggggtagaccgagggaactcgccccgctgcatcctcactgtccaccaccacggtcgggctgccttccaagacttcgggaatgtccactttgcggtggaacatcatggcgtataggaagccatccacgttgtatcggagcagggcggatatttcttggttctcgagttcggcgtcattattggtgttcgtggtaagcagtatgtatccgagcttgctcgcggcatcctgcgcaccttcgagtaccttgctcgcgtacggggtcgtggcgatctcatcggtgacgaatcccagagtattggatttgctggtacgtagggtgcgcgccacagaattgggcttgtaccccatgttcttggcagtcgcacggattttctgcgcaaccgccttgctgacgcgattgtgatccttgttgttcataaccaaagacacagtgcatacggaaacacccgcttccttagctatgtctttgatggataccaatcgtttggacctgttcactcgttgccttactgacgactgcaccattttatcacccccttttttttgcgaacatgtcacgatgtctggtttcgggcgtggcccgtgctctgttccatgcgatcatgaatgtccattccaggcagacggccgaatgaataaataatccaggctgtgcagaacatcggcagcgacaagccgaacaccatgagaattccaggccattgcacccatacaagcacggtaagaatcagcagtccaacctgcagaaggctgcacaacgggcgtgccacaatcatcgccagtgttgtacgaacaatccagacgggacgctccgcatagttcgcgcgtaccacccaaaccaaggacgagaacactgccaaaactacgatgatgagcagcagcacgccggaaaccatgatgtcgaaatcgccgcgagcatgccagttcatcacgtagtagtcgacgatgaccacggcccagagaataatcaaaggccaaccgaaaagattcgcactcttgacttcgcttttccagaagccgtgaaacgtcgtccaaacctccttggcccgcattgaacggtcctcagaaagcacccacgcacggaacgtagcctgcgcagccgcgaacgaggggaaaactcccagcacgacggctcccatcagagtgtgcgcgagtatggccacgttgaccacgaaaatcgcgactagcagacggcagaaccgctcgtaggccacagagaagcgggcaagcatagcgaatcctttctatcagctggcttttagattggttgtctcttgtcggattgcgtttggctcaacccttgaccgcgccgagcatcacacccttgttgaagtacttctgcaagaacggatagagcacaagcagaggcagggtagagacgatgatgatgccgaacttgatctgatcggcggcctgctgctgcgcagccgcgttgacattggttccagtaccctgcgccaccagcagcaactgctgcaacaccacctgcaatggctgcttcttgtcgtcggtgatgtagataaggcccgtcatgaagtcgttccagtggccgacaaagtagtacagaccaattacagccagaatcgcagagctcaacggcagcacaatcttgaagaagtagccaaaatagctcagcccgtcgatctgggccgcgtcgaagagctcttcggggatagaggtttcgaagaaggaacgggccacgatcacgttgtatacggaaaccgcgccaggcagtataaacacccacatgctgttgttgatgccgaggctcttgtacagcaggtagttcggaatcaggccgccggcgatgaacatggtcacggtgaacaggaacatgatcacgcgtcgcggcttgaactcgcgacgggatagggcgaaagcgcagggaatggtcactgccatgttgaccgcggtgccgaccaccgaatagatgatggtgttgagatagccctgccagatgcgctggttggcgaacaccttagcatagccagcgaaggtcacacccttgggtagcagcagcacttcaccgccggccacggcgttcggatttgaaaatgatgcgatgaccacgaaccacagcgggtagagcaccgccacaatggtcaggagcagcagcacattgatgacgcccgacaccgctaggtcacccggcttctgcttctgacgcacgtgcttgttccagggaatatcgttcttgttctgggtaacagcctcaattgttgcagacatgataaaacccttctagaaaatgctcgtatcggaaacgcgcttggcaattgcattcgcggtgatcaggaagatgaagttgaccaaggtgttgaacaggccgattgccgtcgaatacgagtattggccattgataataccgattttgtaggtgtatgtggcgatgacttcggtggccggcatgttcagcgagttctgcatcagatagatcttgtcgaagcccacgttgagtacggagcccatgttcatgatgagcaggatcgcacatgtcggcatgatcgcaggaatatcgacgtagcgaatcagctgcagacggcctgcaccatcgatcttcgccgcctcgtacagagatgtgttcacaccggcgagcgcagccaggtagatgatggagttccaaccaacatgctgccagacttcagagatccaatagaccgcggtgatggcgctggtggagcccatcagtgattcatcaccgaagaagcgaccgagaatgccggtaccaggagtcaggaagatgttgagcatggagacgatgaccaccacggagatgaagtgtggcatgtaggtaatcgtttgcacgaaacccttgattttcttagaaccgatctgattgattagcagggctagaataatcgggaagatgaagcccataaccagtgtccacaaggaaatgcggatggtgttggtcatgatctcgccaaacagcgggttgtggaagaattccaggaagtatttaaagccgacgaatttgccgccggtcaggcctttggtcggatcgaactcgcggaaggcgagctggatgccccacatcggcacgtaggagaacagtcccacgaagaacaatgccggagcggaaagaatccacaactgccagtagcgacgtaaatggtcggcgatgcgatcgagcagacctggtttcttgcggtcgggagccgcttccatcgccacggtccgtgcagcaacgccttgcgatgtttgtgcactcatgttggtctccaatttaggatgattgctagggaacaaaagtgcggggtccggcggcagtcacgggagagaaacgaacccgtgcgatggaccccgtggtattacttggctacttggtgtacttgtcgtaccacttctgccaaatcttgatgttggcatcgaggccgagggtcggttcggacaccttcttcacgtaggcatcccattccttgtcgacgccgcccttctggacccacttcgcgatctggttgttcgcgtagttggagatggcggtgttgttgttctgcagggtgttggaatcctcggtattcgggcgcacgtagatcggtacgacatccttgacaccgtcgacgcggttgcgcgcctcacgaatggccaagtcggacgcagtgacctggtcggcgttggtgtcgttgaccatcttcacgtcgtcgcggatccagccaccgaagcggtcctgcagggcgacggcgcgggtatcaggatattcggcgtaagctttagccttgtcgatggtgtactggtggtcgccgtcatcggagacgatatccgggatggaaccgaagaatccagccacggaaagcttctcgccatacatggcgtcgatcaccttgtagatggcgtcctggttggctgcgttcgggttgacggtcaggccggaaccggagtaggcccagcggcaagcgtcctgggaataatcccacttgacctgggagtcgggcgtggaggcgtccttcttcagcggcggcagggtgacgtactggtcgccaagcgcgttgccgtattcggcgtagttggaccaaccgaaggagacgccggtcagcgcggtcttgccgtcactgacggtctgcgaagtgtattgcgaggcgtcgcgggtgagcacatccttcgggataaggcccttggccatgagtccgtgcaggtaggagacgacgtccttgagcgcgtcggaggtgtaatagctcttaaccttgccgttgtccacataatagccctgttcggaagcgccgccgcccatgaaggaggtgaccacgccttcggagttcatcagcgccagagggctccacaggccgaagccgaggctgcggatattcatcggcacctcatcagccttgccgttgccgttcggatcctgggtcttgaatgcatcgagcacgttctcgagctcgtcccaagtggtcggcatctggaggccgagcttgtcaagccaggtcttgttgatgaacatgtgagtgccggaaacctcgtaacccttgccgcggtcggagggcagcatggcgatcttggtgccatcggtaacgtacttcgcggcacccggctgggccttgaggaacttcttgacgttcggcatcttgtccagatgcggcttgagatcctcgaaataggtgctgtacttggccgcatccaccatgctgaacaagctcaagccaatgtccgggaattcaccggcggccatcttggcgctcttctgctggccccaagcgttgtcagagacttcctgccacttgatggtgcaatcgcaggcggcttccagatccttggtgtactgggtgtcctgcatcggatggtcggtcacgttgcgacgaaccagaatgttgacgattggcttgccgttctcgtctgtggtggcctgcttgttgccgcaggcggcaaacgtcgtgaccatagtcgcgactgcagctattgatgccaacaggcgaacacttcttcgtgccatgattaggctccttcttccttgatgtttcctcctcgtaccgatgtaagacgcaccggtacgaccccgtcagccacttgctttgtggttgtttctttgcggtgattaacactgtaaatcgttaatcgtttaatgtcaaacgttaatcgtttatttcaatagttaacgctctcatctaccagaccgaccagcgccgcaaacgtaaacttcggctccatactgccgttcttgcagaacaccggaatcatccacatcgcgacacgccgttaatcgtataacgtatcgtttttcatcaaatacacgtacagcccgtccgttgtacgcgcaaaaacgtagccaagcaagacggccaccaaagcgacacgtcgctacttacgaaagccgcattcctccttcaggaagaaggagagcacgagtacgctcacagacagcaccaaaccaaatacgtagccgcccgggagccggagatgaagcattcggcatcgtgtctgctgtccatcgccgcgggatacgccgtgcgccatctggtccacagtaaatcatgaaaaacgcgcgttggcgcacgtccttttcatggacgtgcgc

SEQ ID NO: 81 - DNA, 62551 bp, Bifidobacterium pseudocatenulatum
cgagcggacgatgaactggcaatcattgactataaagaagtagtacaaatacgctcttgagttctcaaaccaccaccgctcacccgcctcgaggcaccccaaccggggaaccacccgccgagcggcagcgaagagtcaatttacacgaaccccggcgatcacgcaaatcgacccttccaaagataccctaaaaccgttgcaaataaacacatccctcggcgtgtcccgattccgtccatctgaatcgtctttctccttttccacagaaaccagctcatccttccggaaaacatgttcgtcgtacgagtcgccttatcaggaattgacggaacgatacgttgaggggattctgttatcctgtggggcgcagcggagcaaaatgacctgccaagacgggatggtccctttcatgagcaggcttttgactcaaaatagaagacggatcgaatattccgcagtgataccgtgaagggagggaacggcatggaggcgcagcctatgaggctacaggacctgagactcaaagaaggaatgtctctagaacagctggccgagctctccggcgtggatcatgatcgtctcgtcatgttcgaaaacaatccggaaaccatacgcaatatgcatttggacaccgctcgccaaattgccaaagcattgcactgcaacgtgttggagctccatcccgacgaaggttggagaggcggaatccactgcgctgaatccgggctaagagacattcgtcggactcgcggctatacgcaaaacgagttgtcagagatgacagggattccccagccgaacatctcttggtttgagacaggctatcgctcgacctcaggcatgcggctggatacagccaggcgtctgtcggaagcgcttcgatgcgatccgacagatttcctaaaagaagcgtatagccgatatgaaaataaatgttgtatctgatttagataaaacacttaaatttcatcggacgccatacttcaacaaacgaatgcatcccgcgcacctcccatctcaccaaaaagattaggcaagaaagaagcccatcaatcattgacttcacaaacctttcccttccagaaagctggataacgtccgagattttgcgcactttcggacgttatctggcgcggaggacgcatttgcgcagttcggaagcgatgagcacgatcatggcaaggccgaggcattcgacccatgcgccgacgctgagcggtaccgtaccgaaagcggtgttgaggaacggaatgtaaatcaccgccagctgcaataccatgctcagcgcgatcgcgccccatagccacttgttggagaacagtccgacgaacgctgactgcaagtgcgagcgcgaggcaagcgcgttcagcatttgcgcgaacacgagaatcgtgaagcccatggtgcgtgcttccgtcatttgtgcgtcgtgaccgatcgcatcgacggaacggtcggtgaacagaccgccgtccaagtgcatgtccatgccgatcagggtgacggccgccataatcacaccgatgaaaatgatgtcgccccacatttcggcgtcaatcacgcgatcggtgagtttgcgcggcttgcgcgccatcacatcgtcggtggacgggtcgacgcccatggcgagcgcgggtgccgcgtcggtgagcaggttgatccacagcagctgcgtggcaagcagcggcacggtcacgccttggctgccgggctgggtgatgccgaggaatccggcgagcatcaccccgccgaacacggtgaacacttcgcccacattggagctcagcaggtagcgcaggaacttgcggatgttgtcgaaaatgccgcgtccttcacgcacggctgcgacgatggtgctgaagttgtcgtcggcgaggatcattttcgcgctctgcttggtcacttcagtgccggtaatgcccatggcgacgccaatatcggcggttttgactgcgggagcgtcgttcacgccgtcaccggtcatggccacgatattgccttgccgttgcaaggattcaacgatcttcaacttgtgttccggcgcgactcgcgcgtagacggacactccgctggtcaccttgtcgaatgccgcttcgtcgggcagttcgtcgagttggctgccggtcatggccgtgccgcccttgtcgataatgcccagatcggtggcgatgcgcgccgcggtcagcgggtgatcgccggtaatcattaccgtacgaatgccggcgcgatgcgcttcggcaaccgaatcacgcacttccgtgcgcggcggatcgatgatgccgatcatgccgacccaaatcaaatcgttctcaagcacatcgctttgttccgcaatatcggcaacatgacctgcggaattcagcatgattcccggcacttgcgcaagagaagcggtaccgagcggacgataagcctgacccaacgtgcggtatgcgtcggaggaaagctgttcgacagtcgcaagaatctgctggcgatcaccttccgtaagtgggcgaacggcaccgccgaccgcaatcctgctgcaatatccaagaagtacatcgggggcacccttggagaagacggtcaggcggccggcgtcagcgttgtcttgcgccacgatggacatgcgcttacgttcggaagtaaacgggatttcgccaacgcgctcgtagttggcgtacttgcgatccgccttcacttttcgtgctgcgacgatgagtgagacttcggtcgggtcgccgaccgcctcccacgttacgttttccgcatttccggcagaagcagcagattcgcgcagttcgccgtcgttcgccaacgcgcccacggcaagggtcgcaacggcttccgattcgatgatcccgcgtatttgcgcatgttccatggtctgtggatcgaccaccatgcggccttccggcgcatagccggtgccagtaagctgcacttcgccgctcggagtgaccacgcgctccacggtcatctcattgcgggtgagcgtgccggtcttatcggagcagatcaccgacgcggatccgagcgtttccaccgaatgcagcttcttgacgatcgcattgtgcatggccatgcgctgcacgccgagcgcgagcaccaccgtaagaattgcagccaaaccttccggcacggccgcgaccgccagcgagacggccaacagtagcgaatcgatcacatcgtgaacgtcttggaagccttcggtaagcgcgagcgcgaccagcaccacgaccgcgatgatgcataccgcgctgccgaggattttggaaacgtagttcatttccttttgcagcggggtttcgtcgtcttccgtggcttgcagcagatcggcgattttaccgacctgcgtgcccatgccggtgctggttacgatggcgcggccggtgccttgcgttacggacgtgccgttgaacaccatgttggcgcggtcgccgagggccttcgcctgtgcgagggtgtcggtctttttgccgacgggcacgctttcgccggtgaggctggcttccgcgattcgtaggctggcggcggcgaagaggcgtccgtccgcggaaacggagtcgccttcgccgagcacgatgatgtcgccgggcaccacgtcaaccgtgttgatgcgttcgattttgccgtcacgcagcacgttggtttgcggcgcggtcatgctggagagcgcttcgacggcggcttccgccttcgattcctggatgtagccgagcaccgcgttgacgatgaggatcagcacgatgacgatggcgtcgaacggcaatgcttcgccgccttccgcacccggtacggcgttggctcgttcaatgaaccatgcgacgagcgaaatgccggtcgcggccaacagcaggtagacgagggggtctttgaattgttcgaggaatttcttccatttcggcaccggtggtgcggacgcgagttcgttcggtccgtacttgtcgagtcgacgcttggcttccgcttgactcaggccggtattcaaatcgacaccaagcgattgcgctacggtttgcgcatcggcgagcgacggatcgacttgcgtttgcgtcgcggtttttgctgcttgttcgaaatttcccgaactggtatcgcggaattgggtggattgatcttccttgcgatcaaccatgatgatctccttgggagcgccgcggagtagtcagcactcccctgccgttgcgatagtgcgaaatagcggaaaattgcgattttcgcaaccactcgccgaactgggcaatgctgcgcggttgtgggcaccgggcgtacgccatcggtgcattcctgccattattacacaccgtgcccattttgcaagactgcaacgcaccgtcttttgtcaagatttcacaaaatcgtgaaacataatctgcaatcttatttcgaccgcgcattcgattacacggcaacaccgacggcaatgtcgctaccatctttggcggaagtgtgatatgttatcggatgttagtaaacaaaattacttacgctatgattcgtagcgtacattggcaacgtcgcaatggataggggtagttatcatggcagctcaagaagccgcgcaatcacagcaaacgcaaggggttccggaatcgcgcatcctgcaggcgcggcaggcgaacgcaagctggctcaccgatccgaccgtattcgcggtgaatcgcaagcccgcgcactccaatcatcggtatttcctgggcgaagccaccgaaccgaagcagaatctcgacggtgtatggaaagtaaacgttactcaggccgcatccatcgacgtggaaaacgcgccgttcgccgcagctgacttcaacgatgccggtttcggcgcgatcaacgtgcccgaacacctgcagatggccggctatttgaagaacaaatatgtgaatgtgcagtatccatgggatggccatgaggatccgcaggagccgaacgttcccgaaaacaatcatgtggcgatctaccgccgttccttcacgcttgaccgtccgctcgccgcgacgctggaaaatggcggcaccgtcagcatcacgttccacggcatggccactgcgatctacgtgtggcttaacggcacgttcgtcggctatggcgaggatggtttcacgccgaacgaattcgacatcaccgaagcgttgaacgttgacggcgacaacgtgctcaccgtcgcctgctacgaatacgcgagcgcctcttggctggaagatcaggatttctggcgtttgcacggcctgttccgttccgtggagctcgccgcacagcctcgcgtgcatgtcgaaaccgtgcagatcgaagccgactacaatccctccatggccgccggaacgctgaatgcaaccctgcagttgcgcaatgcaaacgacgcggccaccgtcaaggcgaaactgcgtgacgcaaacggcactgtggtgtgggaatccacgcaatgcgccaacgaaaccatcaccctcaattccggcgcactgaagaacattgcgccgtggaacgccgaagagccaaccctgtatgagctgacggtgcttgtcgtcggccacgacggcccgctggtcgaaaaaatcgtgcagcgtatcggcttccgcacattccgtatcgaagacggcatcatgaagctcaacggcaagcgcgtggtcttcaagggcgccgaccgccacgaattcgacgcgaagcgcggccgcgccatcaccaggcaagacatgatcgacgacatcacgttctgcaagaggcacaacatcaacgccatccgcacctcgcactaccccaaccaggaatactggtacgacctgtgcgacgaatacggcatctacctgatcgacgagaccaatatggaaacgcacggcagctgggttgcgaacaacatcgaaacccccgaaactgcggtgccgggcagcaaaccgcagtgggagggcgcgtgcgtggaccgtatcaacagcatgatgcgccgcgattacaaccatccgagcgtgctcatctggtcgctcggcaacgagtcgttcgccggcgaagtgttccgcgcgatgcacgcccacgcgcacgcgatcgacccgaaccgccccgtgcattacgagggttccgtgcatgatcgcgcgttcgacgacgtgaccgacatcgaaacccgcatgtacgcgcacgccgacgaaatcgaggaatatctcaagtccgatccgaagaagccgtatatttcctgcgaatacatgcacgccatgggcaattccgtcggcaacatggacgaatacacggctttggaacgctatccgcaatatcagggcggatttatttgggatttcatcgaccaggcgattctcgacagcaacggtcgcatgtgctacggcggtgatttcggcgaccgtccgagcgactacgaattctccggcgacggcctgctattcgccgaccgcacgccgtcgccgaaggcgcaggacgtcaagcagctgtacgcgaacgtgcatatgaccgtcgatgcttccggcattacgatcaccaacgacaatctgtttgtttcgacggctgattccacgtttgtgttgcgtattttggctgatggcaagcccgtttggtcttcttcgcgccgcttcgacgttgccgcaggtacaagcgagcatgttgagatcgattggccgatcgacgattaccgcgcaggtgcgcaggaactggttttggaggcgtcccagcagttgacttccgcttgcgattgggctccggctgggtatgagctttcgttcggccagtgcgtggttgcgggtggcaagaacgtctctgcgggcgatgcagttaacaccacttccgatggagcgatcaccttgggccgctggaatatcggcgcacgcagtgcgggccgtgaagccctgttctcccttgcacagggtggcatggtgtcgtacaagcttggcgagcgcgaattcgtgttgcgcaagccgctgatcaccacgttccgtgcgctgaccgacaatgatcgcggcgcgggccatgcgttcgagcgtgcgcagtgggcggttgccggaaagtatgcgcgttgcgttgatacgaaggttgagccgctcggcgaaaccgcagtttccgtcacttacacgtatgagcttgcgattgcgcagcgcacgaaggtcaccattcgttacgttgccgatgtgcttggccacgtcgatctgcatgttgcatatccgggtgaaaaggacggcgatctgccgacgattccggcgttcggcattgaatggatgctgccggtcgagtattcgaatctgcgattctatggcgtaggcccggaggaaacgtatgccgaccgcaagcatgcgaagctgggcatttgggatacgaacgccttccgcgatcgcgcgccgtatctgctgccgcaggaaaccggcaaccatgaggacgtgcgttgggctgagattacggacgattctggtcatggcttgcgcgtgagccagactgcgaatactgaaaccggcgttacgaagccgtttgcgatgagcctgctgccgtattcgagcacgatgcttgaggaggcgctgcatcaggacgagctgccggagccgaagcacatgttcctgcgcgtgctcgccgctcagatgggtgtcggcggcgacgattcctggatgagcccggtgcacgagcagtatcagctgcccgccgaccagccgctcaacctcgacgtagccctcgacctgttctagtttcaaggattcagtcgattcctacgtgcgaaatgcctcccgattcttgatttcaaggatcgggaggcattcgttgtgccgcaaggtgactttcgacctcacgattcgcagttctgtctcacgatttcgcaagatcgtgcgacaatttagaagaatcgtgaggtcagtccgtcaaaatggacgatgagggggattttgttgatggcttaaattagacggattgcctagaatgagggcagaacttccgaaacgttcgagcgcaggcgggcaaattcgcgcgtgtccgagcgtcacgaagcacgctcttccaggaaaggggccatcatgagcgacgcaatgaacaacccgtatgcgaacaatccgaatcaaaatggcagcaacgaacagcagccgcaaggccagccggaatacggggcatacgcaccaaaccagcaatcgcaatcccagcagcagggcggcaatcccaacaattcgggcaatccgtatcaaagcgagcctcagaccccatgctacttcgacggtcccaacgccaacccgaatcccaaccagaacggcttcttctacgcgagctacaccaccggtcagccgtacggccaaccatacggacagcagaacagccaatccgacgctgacaacggcaccaacaattggcagccgatcagcccgttcaagctcgtggaggaatggctcccgaagaaggcaaagaacgcgatccgcggcacgtatgcggtactcggcatcgccgccgtcattctcggcctggcactgctgatttggcccggtgccacactgaaggtcgccgcaatcgcgctcggcgcatacttcgtggtttccggtgtggtccgcattgtgaccgcaatcgtggaactcgggcttccgggaggatggcgcgtgcttgacattctgatcggcctgatgctgtctgtcggcggtgtggtcatgttgaagaacgcggcgctttccggagccacactcgccgtgctcatcaccatggtggtcggtctcggctggatgttggaaggcgtgatggcgctcgtggaatcgtggcgcatgccaagctccgcatgggccgtaatctacgcgctgctgtcgatcgtcgccggcttcatcgtgctgttctcccccgtcagctccacgacctggctgatcctgttcggcggatgcgcgcttgtggcgatcggcatcgtcgcgatcgtacgtgcgttcaccttcggcaagtccaagcgcaagtaattttttgcggcgcgggccgtaaagtctgattatctctgttttcccaggggcaccaagcaacagctcggtgccctttccatagcgaaatcgctttttataccaagattcaaagtcgcacaaccatgaatcttggtattaatactggtatataattgggtatgaaattcggttttaagaaaggtttatcatggcaagcgcacttgacatactcgatgaccttgctccaatcagcgagctcagcaatggtcgtacttccgcattgttgcagcgggccgaccacaatccagtcattctgatcaaacgaaacaagccgtcctacgttctcatgaatatcgaaaactatcgcgctctcatggaacgaatcgaagacaacgaagacttgcttcttgccgaaaaaagactcgacaacagtactggcacaactatcagcaacgaagaggtcatgctcgatctcggcatttccccaagcgacctcgccgaggcacctgagccggaactcgcatgaactggcaagttgaatggcttgacgaagccaagaaagacatgcgcaaactcggcaaagccgagcaaatccaagtactcaagggaatcgagaaagttcgcacaaacccactgcccacctcgcaaggcgggtatggcaaaccgttacgcaatgccgaacgaacgaaactttccaggctttgcaaaatcaaattcagggatatcggcattcgcgttgtttacaaaccgttactgcgaaatggaatcatgaccatcatcgtcgttggcattcgttccgatagtgacgcttacatcaaagccaacaagagacgcaaagaatatggactataagatgcgtccgccaattttcagcgaacgttactttttcttcaagattagccgatgattttacaaaagaagtgacgatcgtcgcatgacattgtcgatttgcccgacgtaagatgaaggcacaacagaagaacgaagaaaagaaaatagacaacaaacacagacttacggcagcggccagaggaatggacaagaaaacagatacgcgccgccaagccgaacgaaaggaaacatcatgaagaacaacactttcaaccaggtcatcaacgccaacctcgcttccatcgatccgggcttcggccagttcgcactcgccaaggcttcctccgacctcttcaagaaggtcctcaacaagtaagaccgcttcctagacgggaggcaaggcgcaggcgccacagcacctcgcccctcttctttccaatccttaaatcacatagcgggaggccgcggttccaaacggaatcgcggcctcccgcttttcacgtacgccggctacccctcctcaacagcgagattgcgggcggcggcgcgttcgcgtgggccgcgcgtcacgtagaagccgattgccacgatgacgaacatcaccgtgcagcagatccacagcacacggctgccgaacgcgttgagaatccagcctccgaccaacggcgagaacgcgttcgacagcgaccacaccaggttgtataacccttggtaggtgccgcgcacatcctttggcgcgatgttcgccaccgttgtggcggcaatcgggaacgtgcccagctcgccaagcgtccacagcacggtcgcgattgcgaacgccacccacgaattcgcgccgatctggaacgcgtatccgaccgccgtgatggacatgccgagcaccagcactcgggtgttgctcatccgctggaacagaccgatcgcgggaatctgcagcagacacagcagaccgccgttgatggtcagcagactggaatattcatccgtgccaaggccgatctgcgtcatggaaatcggcaggccgctgacgatctggtaatacgccagcgtgtacaggaacatcagcaccaccatcgacatcagcgcgccgtcggcgcatgcgcgacgatagctgcgccatacggagaaccgctgcggccgctgcgattcgccggtttgtttcacagcatgttccacggcatttcccgcagctgattccgcggcttgcgacgcccgcgccggcgcgacctcgccccgcgggcgcttgcccagcccgacttccttgaagaacacgatcatcaagatcgtggcgaacaccagcaccgcggcttccgcgtagaacatcagcgcataggagatcttcaccaactggttggcgatgatcgggccgatcgcgaagccgaaattcgcggcccacgtctgcagcgaatacgcgcgcttctgtttgcggaacggcaccacgtcggacacgtacgccgcgaccgcgggcgtcggcatggatgagatggcgccgtaggccagcagcgcgatcgccatgatccacggattgccgatgaacgccagcaggaccagcatcgcggcggagccgagattgccgatgacgatcatcgccgggcggccgaagcggtcggacagcgcgccgccatacaggcagccgaagatgccgccgaaaccgtacatggagacgatggtgccggccacgcccgcgctgacatgcatgtcagacaccagatacatggaaaggaatgacgtgacgaagcggcccatccacaggataagcagcgtgacccacaagccccagaacatgaggggcaatccgaaaatctctttgttcttctccattcttgccatcatatcgagcaatatcgagcggacgcgacgccagtagccttttcccggggtgctgggagaatggacaactatggcaatgaaaaaaggaccgaccaaggggtcgggtggaaagcatcgtaacgcgctgaggggcaagggaccgacacccaaggccgaagatcgcgtatatcacaaggcttacaaggaaaagcaggctaccaatcgtcgtaagatggctgatccgcgactggcggcacgccgtcgcgcggcaaagttcagctcagaatccgacgatctcgtcatcggtcgcaacgccgttctcgaagcgttgcgctgcggcgtgcccgcgagcacgctgtatgtggccgcacgcatcgagcacgacgatcgcacgcgcgaaatcattcgtctcgccggtattcacggactgaacctcatggaagccgaccgactggaaatggaccgtatcgcacgctcctccaaccatcagggcgtggtgatgaaggcgcagccgttccagtattcctcgctcgccgagctggtggaacgcgcggacaagaagtctcgtgccatggaagcggccaactccgcaagcgcacgcattgcggcacgtccgctgttcatcgcgcttgacggcgtcaccgatccgcagaatctgggcgcggtcatccgttccgcagccgcattcggcgccaacggcgtgatcctgccggaacgtcgttccgcttcggtcaccgcagccgcatggaaggtgtccgcaggcgcagccgcgcacatgccggtcgcccgcgtggtgaacctcaccaaagccattgaaagtctgaaggaacgcggatactacagcgttggtctcgacggtggcggcgacgccctcgttggcgaaaccggtttcgaaaccgatccgctggttgtggtgctcggttccgaaggcaacggcctgagccgtctcgtacgcgagacatgcgattccatcgccggcatcccaatgtcgaacatggtcgaatcgctgaacgcttccgtcgcagcgggcatcacgctgtattccgtcgcacgcgcccgccgcgaggccggtgccgccgctgacgcgaagtaatcaacacgaagcgacaggaagtaagcacaacaaggcagcaagtccgaaatacatatgagcggatagtccatacggattatccgctcattttgttgcgcaaatctgtacttggattgattttgcgcttaccgcagacccactcccccgccaacgatctctcgcaacacgttctctcactttcaaaagtcaaaatttttttgagttttgaaagtgaggggtgtgaagggatagcaaaaagcggaggattattagtggtcctccgcttaacggctcggccctgcaatttttgactgcggctacgccgcagactcaatactgccttcggcgcggctatcgcctcgtctcagggcatattgatagaaaaagctccactggagctttttctatcaatgtgcccatacagctgcgtcgggatcgtcgtcggggttgtagccgtcgtcgggatcgtcgtaggtgtattcgtcgtcgatcacaccggaatcggcttcggcgttcaacgcgtccacatccttcgtggtgagcttgtactgcggaagcaccttctccacatagctttgcaccgcctcggccatcggcacatcatgacccgccttctcggccaggaaccaacggtggtcaagcacctcatggaagaactgagccggttcgatctgcgaacggtattcacgcggaatcatgcgcacggtcggttcgaacacttcgcgcatccaatcagtggcgacaatctcaagatcctcaccctcacgccatgtggaagcgcggtaggcatccaaatcgttcaacagtcgacgagcctgattctcctgcacatcaagaccagtcaatcgcagcagcttacgattcgcatagccggcatcgaccacacgcggacgcaccagcacacgcttgccatcttcggcggtcttcatctccagctcatccacatcaaaaccaagctcattgagcttgttgacgcgcttctcgatcttccacatctcatccggaccgaacttgtcggtatcagtcagcgcgctccacagcgaatggtaacgatccaccaaacggttgccgatcgcaatttcgtcaacaccgctcggcagcagcgaaccggacgaaagatccatcaattcgccaataatgttcgtacgggccaaatcaacgtcgtactcgcgctggccttccgtcagattaatctgcagatcaccggtttccgcatcaaccaaaaatgcggagaacgcgtaggcgtcgcgcaggaacaacacgttcgacagtgacacatcgccccaatagaagccagccaaatgcaaacgcaccatcagcacggccaacgcgtcgatcagtcgttccgcggtatcagggcgcagattacgcgcgaacagcgcacgatacggcagtgagaacttcaaatgcttggtgacaaggatcgcttccagcggctcgccttcacggctatgacggcctgtgaccacggcgatcggctgcacggtcggcagttccagcttctgcaggcgacgcagcagctcgtattctcgttccgccacattgcgcgtgatttccttcatggcgtacacttcgtcgcctacgtgcacgaaacgcaccacatgcctggaaataccacgcggaagattagccagcaggtcttccggccaagtagccagcggcttttcccacggcagggtgaacatctttggattcgagcttgcggcggtgattttcagcgcatgcggctccggagatgaggcagccggatcttcggccttcacggaagttgctttcagcacacggggatccatctgtggcaattcaagagattccatgaatcaacaatttacctgttgacctacccgaagaagcaagtatggacgaatccgtttcacctgccgatatgcgatgatctcaatactggaatctcactatccatctcatattacgatcgaatattgcgatcgatgctacaaacagacattacaagccgatatcgtgcttgcggaaaacaaaagaagccccgcaccgacgcggggcttctccaacgagacgataagagaggaagagcacgtctcgtttaatggttgacggaagttcgcgcttccgccaagtttttattcagccacccgccagccgatttccgtaaaggatattcccctgaagaaacagccaacggttggttactcgatatcagctcagttcagacgcagctcggtcgacggagcgaacaggtgcatcttggacgggtcgatcttgatcttgacggtatcgccgaccttcgggagagcacgcgggttcacgcggatcgtggtgagcttgttctgatcggacatcatggtggatgcctcagcagcggagccatcggtgatgatgttgccgtagatgtagccatcggagcccagatcctcaacgttcatgaccttgagggagaaggcgttggcgtcatccggggcggccagggaagcgtcttccggacggaagccgacgacgatctggttgttgtcttcagcggtgagcttgttgacagcctcggccggcagatccacggtgtcttcgccgatctttgccttgccgttgaccaccgggtgggtgttgatgttcatcgacggggagccgatgaagccagcgacgaagacgttggccggacgatcgtacagctcggtcggggcgccgacctgctgcaggacaccgagcttgatgacggcgatgcggtcacccatggtcagagcttcggtctgatcgtgggtcacgtacagggtggtgacacccagctggcgctgcagagcagcgatctgggtacgggtctgtacgcggagcttggcatcaaggttggacagaggctcatccatgaggaagaccttcggctcacggacgattgcacgacccatggccacacgctgacgctggccaccggacagagccttcggcttacgatcgaggtactcggtcaggtcgaggatctcagcggccttctcgacgcgcttgcgaatctcttccttcggggtgccggcgatcttcagagcgaagcccatgttgtcagccacggtcatgtgcggatacagagcgtagttctggaacaccattgcgatgtcgcggtccttcggctgcatcgtggtgacgtccttgccaccgatgaggatgcggcccttgttgacctcttcaaggccagcgagcatacgcagagtagtggacttgccgcagccagacgggccaaccagcaccaggaactcgccgtccttgatgtccatattcaaatcatccaccgacggcttatcgttgcccgggtagatacgagtaacatggtcgaatacgacttctgccatgatttgtcatcctttcagaggcaggtacgtgcctcacgatccgttgtaaagggatttcttttcggtgcctcgccttgcggcttacgacttcgacaaagccacaattcaaagcgttaatttatttctttggtttggcgaaggttctcttcgttgagccacgttccatgatacatacaacgctaaaactgtcaatgcgtgtcgcgagtcgcactgtttacctacgttggcaggagggggttaacggcgtagtaaatacacgcatttatcgccatcatgcaagacaatggtgcggagcgaaagacagaacagggaggttgcagtgcgcactattagaatcggcgtggtcgaggatgatcccgcaagctgccagctggtacttgactatctcaaccgatatcagcaggaaaatgacgaacaattcaccgtttccgtattcgacgacggcgcgagaatcgtagagaaatatacccctgtttacgatattttactgctcgacatcgaaatgagcgaaatggacggcatggccgccgcgagacgcattcgcgagcgcgacgacaaggtcgtgatcgtgttcatcaccgccgcaccgcagtatgcgatcagcgggtacgaggtgcgcgcattgtcgtatctgctcaaacccctgccgtggttcgcgttttcacaggaactcaagaagtcgatcgacatggtgaggcgcaatggcgacgattccacgcttatcgaaaccagcaacgggcagatgcggctgaatcttgccgatattctgtatctcgaatcgatccggcataccatcgtcatccacacgttggaaggcaaactgtcgatcaatggcacgctcaaagacatggaagcgaaactcgccgaccaccatttcttccgctcgaattcctgctatctggtgaatctcaagcatgtgacgggcgtcgccgaccaggattgcgtgatgtcgaacggcgaacagttgcgcgtaagccgaccacgcaagaaggcgttcctcgccgcgttgaccgactatataggaggtggcaggtggccagcgtgatattgccgaatgcgctggccggattggcaggaggactggcaggaggctcctcttccataccttccgttttggtgaccgtgctttcggtgccgccgatgacgccaatcaccaacgctctgcccgacatcccccgttcttatacggcgatctgcgaatgggccgcgtgcatggtgtatatcgcggtgtcgtatcgtcgcgtgccgctccgacggtcgatcatcgtcagtgcggccggattggcatcgctggtcgcggtgcagtatttcgacggcagtatgccgatctggttctggatcatcggtatgctgctcgcattcgcctgcatgtatgcgacgattctgctcggcgcgggcaccggcaaacgcgagggcctgtatattacggcgcgcgcgttcgtgttggccgaattggtggcgtcgctgcattggcagatcgttacgttcattggcgtgcgcgacggattcgccgattacgattggcgcgcgatcgcgctgcttgtcgttacgtatgcgctgtgcttcggtctagcttggatggtggaatgcggcaatttcagccagaccacacctaccttgccgaccgcttccgccgcgattgcgacgatggccattatgatcgtcacgttcgccatgagcaatttgagtttcgtgtcgacgaatacgccgttttccggttcggtcggccaggaaatcttctacattcgcacgctggtcgatttctgcggtttcgcgatcctatatgcgcagcaggagcaggcgcgccgtattgaggcgaatacggaactcgcgtcgatcaacgcgcagctggaaagccagcatcaggaatacctgcaatcgaaggaaaatatcgaatcgctaggccgtcttgcgcacgatctgaagcatcagcttgcggcgttgcgtgccgaagtcgatccgaagcatgccgcggccggcttcgagcagctggagcaatcggtgcagcgctatagcgcgcagcagcataccggtaatcccgtgcttgacgttattttgaccacgaaagagcgcacgtgcgccgatcgaggcattacgttcacggcggtcgcggacggctcgctgctaagcggcatgtcgtcgatggatatcgcatcattgttcggcaacgcgcttgacaatgcgatcgaagcgacgtcgaaattgccgaaacgtgagcagcgtctgatcaaacttgcgttatacgagcagaatcgctttattgttatccgtgttgagaattattacgattcccgattgaagaaggatgcggaaggcaatctgcgcaccaccaagcgcgacgatcagcatcggcatggtttcggcgtgaagtcgattcgtcatatcgcgcagcagtatggcggcgaagtgacgattcgcaccgaagaccactggtttgtgctgaccgcgcttattccgcggaaaaccggccttatggccatgtaggactggccataaggcttaaggcggctccgctagttttcaagattctgcgcagcggcatcgccgtcagacgcatcaccggcatcaccgcctgccgatgcgtcgccaccagcatcgccggcattcgccgcacctccagccgacccgccagccgcaccgcccgccgcagcacctccagccgcaccgcccgccgcagcacctccagccgtattgtccggactattcgcagcaccaccgttagagcccccgttagtgccgatattggtgttgttcgtcacggtgttgggagtcgacgacgcctcctggtattggtccatcgcctgctgaacggcgtctttggcggcattcagcgcgtcaacggcggccgtcacgtcgttttccttgagattggtgccattggcaaggtttctggccgagtcaatcgcctgctgcaatgccacgcgcacgctgtcatcggccaccatgccgtcggaattgtcgagcacggactgcgcctgctcgatcgcgtcattgagctggcccttcagacgattctgcgtggccagcactttggaagcgtcgacggcttcggccgcatttgtaatcttttcggccttgtcgttcatgctccgtgcctcggatgccatggctttcgcggatttcttcagcttactaatgccctgcgacgtgtcgcacgacaggattttcgcttccttcgcgttagatatggccgcattgagcttagtgacggtgctgacgtcggcgacttgatcggcagtgaccttcgcgccggtttttccgatttccaaagcgtcggaaagcgtgttattggcactttgcagctggcttgtggaatcctggcattgcgcggctgcgctggtaatggctgatttcttggaattattcgaaagcatccaacatgcaataccgccaatcaaagcaatcacgacgatagccgcaatcacgatagcgacgattttgccggtattcttcggtggtaccggaatttcattgctgtaatcgccgtaatcctcgaaaacactgaaatcgcttacaccgttcacatcgctttcttgcgaagcgaccgtcggaggcttcggcggttcggacatgtcagcccccatcacctcggtatccgtcggaaattccagcctgaaattgttgtctttcgtcatacgtccttcttcatcatcgggcgctcagcatcgaccatctatacgccgaccccctagcttaccgcctaacacacccttcaacgcgcattcgccttaattaccttcttttccgcacttttcgataagcgcaaagcggcaagcggctcccctaaacgcgatgcggtgaacgcactcaccgcaaccgcgaatccaatgggcacaaacagattgatcggagcatccgcaagttccatcaccaagcaaatcgccataagcggagcctgttgggaagctgcgagcaatgcgcacgcacccagcagagcgtacatgccaatcgaattcgtgtgaaacacctgcatccacagaacacccagcacagcaccccccgaagcgccgagcgcaatacccggctgcagcacaccgccggaagcgccggaacggatcgtcagcaatgtgacaatcgccttcgccaggaacgaaaccagcaaaatcggcaccaccgccaaatcagccttggacgagaaactcaactgcgcggtggcacggccattgcccataacctgcggcacccaaatcgccacaacgccagtcagcaggccggcgagcggcaacatccacagaatgcccacgcccgacggcttggacttctcagcccactgcgagccgcgacggaacagtgcgccggcagcgccgagaatcatgccggcaaccagtgcgaacaccatgtaatcgggggtaaacaaaccgtcggtttcaccaatcaaatagaacgtgtgtgtgcccttgaccagcgacgccacccacgaagccagcgcggaacaggcgaaagcgagcgtcaccgtttcaagggtcacatcggcgagcagaatctcgaccgcgaaaaacgtgcccgcaagtggcgcgttatacacgcccgcaaggccggcggcggccgtaatggccaccaacatacgggtgtctttcgcatcgagacgcgcccaacgcgcgaaccgctgaccgaacatcgcacccaactcgcgcggcgccacttctcgaccgatcgacatgcccgtaccgacaatgaaaatctgcagcaacacatgcacgacggtctgccaaatcggcataatatcgccatttaccgcctttttaacggacggcacttccgtgctgcgcgtacgcaacagccaccaaatcacggcggcgacggtcgcgccaacggtcacggaaatcaagcaccgaatcgcaggaacgttgaacgggccggattcctgcgaattttcaacataaccgagcgcaagatgctcaacgccgtacagcataagcgtcagcaggccagcggccgcgccaatggccacacccacaatcgccacagcagcaatcagtgccggaattctgccgatttttggctgcgttccttgaggattctgcgactcctgcgattcccgtgttttttgcgattcctgcgattcccgcatctgccgcactccttgcacaccgtctccttcgttcaattcattcccccaattgtcccacctgccgcaacgttcatttgttacgccccgagcgtggcgatcggcagcaccagaatgccgtcatcacgccggtatgcaatatcaccacgcccgacaataaatgccatgaattcaggctcacgaacttgagatagaggatttccgcacactttttctttgaaagcatgtagtctgtccacatttttctccatgactttcaagtcgctcagcttaatctccaccgcagcccagcgaccatccatcaattcaagaatcacatcaacttcaaggcctttttcatcccgataatatgcgattcgattcgtgccacccatcgattcgagatacacacgcaaatcacgaatcaccaatgtttcaaacaaatctcatactgaatcagagacaataatgatgacgctctcagcttatccagcacaactcattgcacatcatttgatagggattgctgcgagagctgcatctttaggtcatcgacttttaattccaaacgtctgatataaagcgcctgtcgacggataatcaaatcacgcatatcatttccaccggttccagggttaccttcattcgtgcgactggaagtaacctcagcatcggggagattcactctgtctaccgtgcctggatcttctattcgtattgtcttcctccaacgatgcatgcaccgttcaatacgcttttcgcctatcaactcaggaccgagccccgcttcgcggaacagcacagtgggagattcaccattttcagcactcgaaacgcattcacgcttgaaccactctgcatatcggatacgtgaaccagtaatacttatgaccgcaggcagcgaaaccagatattgtgcttgttccggagagaatcgttcgtcgctcatgcttactttttcacttcatcgtgcaatcatctgtatgggatttgccggccgaattgacgtcccgtatgcggcacctcatgcgcaatctgaacaaaatgaacgcaacaagtaacatgagccccgctgccgcaacaatgctgcctacggcggcacccgtacgaccgataaggccaggattgcccggctcctcgctcgggttattttcgggcggggcaacaggagttccagtgctaaatttcggctctactgtgatgttgagatcagcggatgtgtctccactgccaggaatcgagatgaggaacggatcacagtcgtatgctttgttggctttcgccgagctcgtgcgggagaccagatataggccgagcggcagattctggaaagtgagctgaccagctacgttagtggtgccggaatgctggtacagcttgtttttcgccgcgtgcgtagcgagcttcttggcagcatcgtgatattcgctcgatgtcaggcgttcccaatcggcagtgagaccggaaaaatcactgacggttttatatgaggaaacgctaccgttgctgttcgttgtgacggtagcgacgcgcacgatggcgtaggtatcgccggcaagtgatttgggtgaagccgcgtctcggttccacacggcattgatggtgagagtgccgaaggaatcagcttgcgcgtatggcaccatgaagccgaaagacacaagaccagtgaggatgatagtaatggtggcggcaatcatggcagcaatgcgcgccgcaccatactcgcttccgctatgcgggtctaacatgtctgcccggtcctttccgtcgtgatgaatgtgattggttatttgtattggctggctgaggaggcaagtcaccgtccggctcgatggctgtggagctagaatcaccggatgcgaccttggcgctcccactctgccggcgtcgccgctcatgccgctgccacaaatgccatgcaataagcaaggcaatcagcgcgagagacggcaacaaatactgcagcggaatgtccacgtggaatgtggatttggcgtcattctgctgctgtggtgtgtatggaatacgatgaccgcgcaccagcagccgatgcgtgttgaccgcatacggtgtgcaggtaatgagcgtgaccaaatccttgccgggctcaatcgccagttgtttggcatcagtcggcagaacggtagtgatcttatcgacctgatacgcatacgtgtctttaagtattgtgatatagaacttgtcgccttttttcataaggttcaagtccgtgaacagttttgccgtgggcaaccctcggtggccagacagcgccgcatgagtggacgcgccaccaactggtagtgaggtctgttccaagtgaccgatgccggattgcagtactttctcggaagtgccgtgataaataggcagggtctccttgagcttaggcacagtgacgtatcccatcatgccgtcgccggcgaggttgaggagcttcatgtactcggcgtcggtggcttcggtgtccaccgctccggtgagggcgctggtggtgccggagctttcctcggcgagtctggtgttgtaggcgtgcgcggcgtcgatcatgctgcggtattcctcgtcggagagtgcctcgacggccgcgtcgtagttgctgacgacgcgcgaggcgttcttcatgacgaggaagttgctgatcgtcgggtagaacaggacgagcagtccgatcacgatgaccagcaacggcgcgaggccgcgcagcttcttaaccatggatctccttggtggggcttccccggtcagggaaggccggcgccccggtccccttgacacgggtcaggggaaccgggggtcagtggcggtctcaggccgcgtgacgggacttgcggttggacttgacgtaccaggtcgcgccgagggccacgatggccacgccgaacacggtgaacagcacggtgcccatgccgccggtctcggggagggtgacgcccttgttgttctcgacggtgatgaccgggacggtggtgccctgcgcgttggcgttgtttaccttccaggactccaggatgccggtgttctcgtcgtacgtggcggagatggtgaccgtgatcggatccttcagcaggttatagcctgtcggagccttgatctccttcaccttgtaggtgccttccttgagaccggtgaactgcagcttgccgttattgtcggtgaccacagtcttgtcatcggcgacggtttccgttcccttggccgggcggaacacaccatcggagaccttcacaagattgatcttggtgccgttctcgcgctgcagttcgaactgggcgcccttcagcttatcgttgtggtcgaccgcgttgaccttctcgatgtcgaagttgaaggtgtaggtgtaggtcttgtcttccttggtggtgccggtgccgttagaggccgggtcgttgctgtactcgatcttcgcgtcgttctggttgccggtggaaccgacctcggcgtccttgttcagggtggcggagtactcgacggtgatggccttgccggcgtcattctggtgcagattcttgaagttcatcatgttgacttcaagagcggtcttaccagtatcggagtccgtggtgtacgtagcggtgtagtcgaggtccttggtcagcgtggtatcgccgatcttgacggtcggagcgaacgtgccgccctcggcggtgccgttcagagtaaggcccttggacagggtatcggtgaacttgaaagtgtagccgttggtgtactcggtcatgtccggcacggtggaggcgagcttgaagtccacggtgtcgccgatctcgacgctgttgtgcttcttgtcgtcggtgccgttcttgacggtcttctggatggtcgggtaggtgctcttgaggtcctgctcgacggcggtgctgttcagcacattgagcaggatggcatcggtgccacgcttgtcactggtatcggtggaaccggccttcgggctgacgaggtaggaaccgtaggccagatcggtgaacgtcgccgtgtacttaccgtccacggcaatcttggccgcgctctcggtcttaatggtcaggccggtctgggtcttcgcccaatcggaggccttcttagcgaacgggacgacctgggtcttcccgtccttgaggccggagacgtagtcataggccctttgggcgacgttgtcgacggtggtgtcatcgccaaggttgaactcagtcttgttcgagatgaagaactggttccactcggagttcagcgtgaagccgccgttgtcggcggttccggcgttgacggcatccagatcgtaggagaacatctggtaggccttgatttccttgccggcgaactcggcgttggtgctgctcaccttgatgctgccgttggcttcctgagcgttggcggtggtggcgccgaggccggcgatgccgagcatcgtggcggctgcgaggacgcccgccgctacattcctgattagtggcttcatcactgttcctttctctgtactgcaccggtcccggtcggggccggttcgagttggttacattggttgccccgccgccgtgcgacggcgggaagtctggttatcgggtgtgccgaccgcgtttgcggccgaccggcagcgcggttcccgcgcccgctcccccggccgcggccggttccatgcggttggcgcgcaggtaccatgcggtgccgagggcgagcatgagcacgccgagcatgacgaacaggagcgtgccgttgccgccggtctcgggcaggggcgagaagttcgtgacggtggccacgtacttgccgtccttgtccgtgccgtacttgacggacaccgagtaaccggcctcggccggggtcttcgtctcggcgttgccgtccgtgtcgccggaggcgtaggtcatgttgagctccttgacggtgtacgtgtagtagcgcgtcacgtcctcgccgttcgggccggaacccttatcaacgaaggcgaccggcaggccggtgagcttcgtgcgccacgtgtcgctccacgcggagccgttctccttggcggtcatggtcaccgtgaacgggttggtccgctcctcggtggcgcagtcgtccttgaagcattcgagcttcccggccttgacctgttcgcccgccgcattcgtgtacgtggcggtcacctcgagggtgatggcgtcggggcgttccagctggccgttgcgccacactttctgcagggtgaggtccacggtcttgcagccgtccttgccgcatgggtcctggccgtcgtccggttcgggggtgagtccgccgttgttgtcggatacgggcacgtcaagcatgagcactgccttggctggggactggtaggcatcgagctttgtgctgctgccaccagccacagtcacggcatccttgatgccaacccatgtggtaccagcgtcgccggatgcaccactgtgcacagcgccgctgtcgtatgtgttgaccacgtcgaacagcttcacttcccagcgatcgagtccggtgttcagcgcatcgtctgccgtgttcttctgcgagaagatcttgttgccgtcctgtgcggaggtgcgggcctcaccggcgttcgcggccgccttgcggtagatgcgataggtgttgtatgccttgccgccgttgccttcatcgaccggtccgaggatgtcgctcatggtgttgaagtcccatacggacttgagtttggtgttcgagaacgggtcgaccagtccgctggtgccgcggatcgtgtcggcgtagaccatgtggtcgtctgccagcacgccctcgtcgttcagtccggcgaaaccgcccgcgtagcctgtggaaaggtctttcatgccgtcggtatcctgagtcgccccaccaccgaacacgtcatagccgctggcgatgcccgtcacggtggactgttccacgcgggtgcggttgcccttgatgagttggacggtcaggttgctgcctgatccacccatgtcgatgccgttctttctgcaaggcagtttgatgacactatcgccgatggtgacaatcgccacgtcggtctgctgctggttttcatcatcagccttggacagggcgacgctcaccttcagtccgaacaggttcacgtacagcacgttgccttccgaaagcaccttgagatcgaataccttgccgaagatggccgggaaccacttgcccaagtcgatgacgccgatctgttccgccttgtcgaggtacaggagcttgaccagcgcgttcaccactcgcaggagcaggtccacgagtaccgagttgacctgcgcatcaaccaaataggcgcggctggtttcgccgacgaatccgccggcgatctcaccgctggtgaccttcttgagattgtcagacgtgcagcccttcactcgggccaagtccgcgtagccgacgaatccgcctgcgacctcgcgcccggtggccttgtcggtggctttgccgtaattgtcgccatggtgtgtggcggtgacggtgtagccgtccgggatgccggtgacgcgcgaatcgccaacgtgcgagccccagatgtcaagtacgccggccatagcaccaagcagattgagcgcatccgtgccgagttgtgcattgtcggcggcgaccgtgccggatttgccaagatgcccgatgaagccgcccacgtagttcacgccggtcacactgttgaggttggtgaccgcagactgcttcacagagccattgatcagtccaccgccgaagccaccgaccgcaccggtgtaacgcttcgagtcaagcatgccctttgtggtggaatcatgggcgacaatctggatgccgtcgctcacaccgttgacctgaccgtcatagatgaaggtgcggaatgcttcgagcacgcccacgttgccgaccttgagcagtttgagcagcaggttggtatcctgcttatcgccggcctcgccgccgccgacggaagcgacgctggatacatcagcaagaccaaagaagccaccggcgtattgcccgccttcgacagcgcgcagcccgttaacagtaagagaagccgggtcattgttcggatccgcttcactgccggtacctttggcggaatccttgtcaccgaggatcgcggcttgcaacgaaccagcgaaaccgccggcgttcagggcatacttggctgtggtattacccttatcgtccttgctctcatatgcgccattgaccgtgtatccccatgccgggtcatccgagctcacatgtgcaccgcgaatcgtcgtaaccgtggcctgcaatacgctgaccaggcttgccgggttcgataccagcgagtcgaggattccttgcaggaatccctcggacgcattggtgtccacatccgcaaccgcaccggcagtggccacgccgataaatccgccgacattgttgcgcccttccaccttgcgcaggttggaaacgttggcgccggcagcggtgacaccctcgacaagcttctggccgttctggtcgagatcgccccagatctggccaccgaccgcgagaccggcatagcctccggcattaccggtaccgtgcgtgatgtcttcaccggtggccacgaccttcatacccttgcggtagccggccacgctcgaagatttgacgacgggcacaaatacctgtgccacgtcgagcatctgtcccaaatcaagtttgatgcctttgtcgccgaatagttggatagagccgaacgaggatgccgagccggattccatcgtgcccgcataaccgcctgccgcacgcatggcagagacggtcttgacatccatcgactggccatcggtgatcgtgccggtgcgcatcagaccgacatgtccgccggcgacgccggaatcatgcaagttcgcgccagtctgatactccgcacgaccggcgacgacgttgaatccgaagatgtaggattcgaggaacttgtccagggaatcctggtcggtaacagagcccgcaccatcagccgtggtcacatcggtgaattccttgccatacgcaccgtacttgccgatgttgtcgacccacgtcttccactggtcgtagctcatattgcgcagcggaccagtgaccttcgagtgctcctcggtcgggtagaccacggacagcacgccggcgaggttgccggccttgatgagaccgccgagcaaggagagcgaaccgccttcagcggtatcggccgcttccatgaagccggtgtagccgccggcgatttcggcaccgtatacgctgcggatgcgcgcggcataggctacgcgttgcggcccgttgtatttgccgtcggtgttctcctgcttccacgctgcggtgttgttgccccagatatggccgccgcggttacgtcccgcatagccgccggccatgccgcggcgtgtggtcgtatccgatgccgcctgtgcgcgcaccgcgccgccgcacactgtggcatcggtcgagctgttgcgaatcgtcggcacgaagtcctgcacgagcgagagcaggttgtcgaggttgacgagcttcttgagcacgctgccgtcgccgagtacgtttgccacggctcccggctgcatggtgcccacgtagccgccggccgaaacctggccgatgatgtatacgaactcatgcgagctcgagtcctgaatatggccgccttcgatgtctccggcgaagccgccggccatacccagtggatcgggcttgttgttggcgttcctatggtctgccgtgccggccagcacggagtatccgccgatgccgccggtcacatcggaatgttcaatcgtcgagacgacgacagccagcacactgagtacatcgttgagattgacgttctggccgagcaggctcaagccgccgcccacggccgccgccgagccgatgtccattttgccgatgtagccgccggcataccgagcggcggtgactgcatacgagctgtctttgctcagataggtgtcgtcgatggatccggtggtttccagattcttcggtgccttgacatcagtacggcgcagttgggtcacactggaatgggacacctgcacaccggaaccgtatccaatgtagccgccggcggaaccggattgcgtatcggactgatcaaatcgggtggcggaaacggtgaagccgggatcatccgggtcggaaatcttgttaccgctagttgcctccacggtggtggcatcggaatgcacacccgcgtaggagatgaacggcacatagccctgcaccacctgcaacaggttggcgagatccaccgtaccgaatttgccgagcaaactcaggccgccgttgccagccgaagcgagcgcgccggaaacgaccttgccgccgaaaccacctgcgtatgcgccgccggtcacatggtcaaggttgacaacggccacggggttggcttgaacgcgggactgcacgtctgccagcgttgagtcgttctcgagatcggtttcggagaactgattgaccttgccgctttggaagtttcccgcatagccgcccgcgatatcaccttcgacgtaaccgccgttgacgtacgtcacggtggtatccgtatagcttggaatcagatacggcatggcaccgagcaggtcgttcacggacagcagtccgcccttgatgaggttgtccaacacgctggaatcatcggcgttgctaagtgcgtcggcgaggccgccggtggtggagaagcccacgaaaccacccgcgatgccatcggacgtgctggtatcggctgtgaccgatttgaggttcgtcacatggctttcccgggtcttggtgctgttggcctgaccatagaaaccgcccgcagcgtaatcggtggtctcgttgttctcgttcttgccggtcgccttgaccgtgaatccgttggcgatgccgttcacattcgatgcagtgactgcaaccgaagaatattgggcaaccgatagcagaccggaaagcttgataagcccaagcacattgagaccgccagcaccgatggcgtcgcctggtccagagaagccaataaaaccgccggcttctcccctggccgagaccgtggccagattggtaaggttcgtgttggccacgtcgccgccggtggcgcatccgatggcaccgcccgcatagtatgaaccggccttcaccgtcaaaccggatgccggagcggtgacagacatgttctccacggtgaacgcggcaaactggtcgaacttcttgagcgtggcgatatcgccaattttcaccacactgttgagcaacccagctaccgttgtcggttgcagattgccggcgatgccacccgcgtaggagcccgtggccgtgaccgattcaaggccttctatggtggtggagcgctgctgagggaagtcacgaggattgttgtacttccagaacgtaaggttcttgagatgatcctgtgaggagtcgccgatcaccgtgcccgatccttcgcccacgagaccgcccgcgtaatcgccaccagccttaacggtgagggagcccttcatctgcgtgccgagaatcacagaaggattcacaccgacgatggatagcagttctcctgcaccgttatcgctgccgctcagcaatttagtcacagccttggtgagctgtttcaacagcgatgcattcgtggtatcgtccgtaccgagttccaggccccatcccacggaggcgaatccggtgaatcctccggcgtgggatctgtcggcagtcacggcgaccgaagccgtaatcgaattattgacagcataggcattggccatggcaccgttgaagccgccggcgtagtcttcggcctgcacggtgatcttatcgtcaccgtttaccgtcaggccactgttttcgatgaggctctgcggacgcagcgcagacagcaagtcgacgccaagcgagttaatcagaccgcccacgttgccgttgcgacttattccggcaaaaccaccggcatattgcgttgcccgcacggtgaaaccattcgtgctcgtcaccgaagagttctcaatgattgcaccaatctgcgcaccgacgaagccgccggcctgcgggttgtccttgttgccgatcaccacattctctttgaacccgttcaccgaactattcgagataaccgggttgtagtagccaaccggaatcaaggcattcagcccgagcgtgccggacagcaaccagtccaccaaatcgcccagcccgaggaacgggatgacacccaagatcttcgagagtacattggtgagcgctcctacgatgccggagactgcatcgtatcgggttgcgccctcaacatatcccacgaaaccaccggtcatacggcttacgctagataccgaaacatctgctacctcgcagtccgtaaccttggtgtccccgtagatacggccggcaaatgcacccgtggcgaggttggaaggattgtctttgtgcagggtgagcagaccttgaagattgaggtcaagatctacttgtccgaatgtcaatagttttaacgccttcaacagtgtgtcgagcagtaatcccactgccgaagtgagtataccgagcaaggtcggcggaatatacgattcactcgtatgattcgtcaccgacacatcctgcagcttgaggttcgacaccacggccgtaccggcgctgcccagactgttgctgttcatcacggtcttgttcgtgatcgaggcgaagaagccgatgccctgctgcttgctgacatccagctggtcgcctttgacattagagaccatatctttctgattgacgaccacatggctgatgaccggccgagctgcggtagcgtgaaccacgcttgcgccatcggccccaacagccttccacaggctggcttcggtgtcgccgtcattggagaccgcaccgagcatagtgccggagaacatgagcggagtccactcggtgttgttggtatccgccgcgttcttggacaggtcgatgtcacggaagatcaggtagttggcgtctgcggaataggtcaggccggtgttggcagcggagtagtccgtttgcgtgccatcagcacccacgccgtaatacttggtgcgggtcctgttgacgcttaacgccgtgcatgccagcagtggactgtcgtggtcggaggcatcagcatcgcgcaaaatatctgaatcggagagatcggcgtcaccggcgtattcggaagacggcgtgccgtccacccactgataattgagggctccttgctgcatgcaagtctgcgtgaccttgttgatgcggccaataaccttcttgccagaaccaatcgcacgcagctgctgctcgttaccaatcaggatgtaggtcttgccgttgatctccttggtgacctgaccctcaaagtcacggccgccaagcgccgtcgcggcgacctgcacatcggccttcgccggcgattgatccgtcgcatttgaggaatcgttcttggcatcttgagaagaagcatcgtttggagcctgcgtttgggctccatcattagtggaattgccagcggtagcttctgctgagtcgtccgccttattgtctgtcgcaccatttgaggattcggaagaatcaccagtagtagaagatgaaggagatgaatcctgctgtgcgtcttgattcgtttcggaaggtgttggcgcaccgtttgatgtattggcctcttctgacgtcttatcgtcaacgttgacattgcgggcagaaggagcagctacgacagtattacccccccctcagaaattacggcgttaggagagctactcacatcgtctatattctgagcatatgctgcaggcaccatgcacacgatggacaaggaaacagcaataaccgaagcaaggcaacgcttcaaagacaggcactgccgtccagattcctgttccgttcctccgttaaacccgcaacggacgaacttcaattccgagctcattgtctcccctcatagattcgcaatcccctttcgggagattactgcatacaactatacggaagaggttgacaaaagaacaaaaaacgttcatttgctggggccggttagcgtatgtctttctgagcaaaaagaaaagccccgcagctatgcagggcttttccaacgaggtcatgagagaggaagagaacgaccccgtttaatggttgacgaagctttaggacctcgccaaatcactcatcattccgcactttcaagtttatgccaatcccgttttcgattttacgctgttttgactttcgattttacgccaatctcgttttcgattttacgccggcaacactgctgacgattgcatttcgatattgagaaatcacaagaaactacaggaaagcagcaaaaggtcataagaaaacccgcccgggaaagagggaagactgggcgggttgaggaagggaagaaaaggaggtcagttatggattacttggcgacctccttggagtccttgttcttcggcataacccagaacttgagcagcgggtagctcacgatcacggcgagcagggtgttgaccacggaagcgatggtgccagcaatgccagcgcccatgtcccaaccctggcacagaccggtcacatagcccggcagcacaaggttcacaaccacgatgatcacagcgaggatcacgtacttccaagcggcatccttgaagctggagtcagacttgaacacccacttcatctgcacgaagaagttcaccacctgggcgagcgcctcggcaagcaggaaggtgaggaagccgcccagaccgttgccctgagtgtcgtagttgaagatcaggaagtggaacggctgcgtcaggcccatgccactgatgaagatggcggtgccgatccacgtcaccacgaaacgggtgatggtggagatgttcgacagcacgttgaacaggatgaactcccagatgttcgggtggtccttgatccactggcggatcggaccgaccttctcagccggctgcgttgcgttgttatcagtcattgttcagctcctttgcagtacgcttgtttgcggattggttgcggaagaagccggcgatgacgccgcccaatccgcggaaggtgtgtccgttggcgattttgacgatggcgtcgaccatcgcggaatcgaccatgccttgggtcatcttgctcatggctcgcggaggcatgttcaggatgaacagggtgttgaggtccggagcgccggtcttctgacgaatcttggcttcctgcttggtgagcgtcttggcgacggtacgtgccacgaagcccttggaatccacccacgacatgatcggatcgttcacgccgaacgtcaccggcttgcccggtgccacaacctcatggccgaacagcacggccatttcggcgtcggtcacttccttgacgtggccgctgagataatggccgagcgcagtatccgcggcaaccggattgacatcgcctgcgacggtgtgcggaatcgtaagcggcaggtgttcggcgttgtcgcccaccatcagcgtccactcgccggtttccgtcttccattcgttgctggcagcgtcgaagtgacggaaggtgtaacggtcgaaatcgatgtgcacgctcttgctttcgtgtgcggcaagcgaaaccttggcgaagcccttgagctcgcgatccggacgcaacacaccaccctgcggaccgcgcacgtacagctgtacaacggtcgaaccggcaacatcggaatcgttgctgaccatcacgtcaatgccgttctcaccagcagtggcggcactgtaggtgaacgtggagtagctcaagccgtaaccgaacgggaagcgcacgggcacaccggcggtctcgtaataacggtagccaacgaacgggccttcgcgatagatcgcatcgcgaccaatcgccggataccaaccggagctcgggcaatcctcgtaatgcatcggccaggtttcggccaagtggccggacggattgatctcaccggtcagcgcgcgcacggtcgcggaagcgccggcctgacccgacagacccacgtaaagcactgcggcaacgtcgtcaatccacggcagttccaccggagagccggcgacaagcacgaccacgatcggcttgcccgcgcccttcagcgcttcgaccagatcgttctgcacctgcggaatcgccatggtggaacggtcaaggccttcggattcgctgcgttcgtcaagaccgacgactgcaagcaccacatcaacgctttccttgccagccagcgcgactgcgtcttccacgagcacgcggtcagccttgccctggcggtcatagccctgctcatagccggcaagcacgaggccttcggcgttcttgacctcttcaagaacgttctcttccttggtggcgttcaccttggaggagccggaaccctgataacgtgcggttgcggccatatcgccgatcaccgccacgcgggtgccggccttgaatggcagggtcgcgttatcgttcttcaacagcacactggagccttcggccaccttgcgtgccacgtcgtgatgcgctgctgcgatatcgtctttgagcagatcgttacgtccaacaccgaccagcttggtcgctgccgcgatttttgcgacttctgcggcacgcgcgttgatatcggcttcagacagggttcccgccttgaccgcgccttccagctcacgcgcggaagtgaagcccggagacggcatttccagcgatccgcctgccttgactgctgcgaccgcggagttggatccgccccagtcggagacgaccatgccgtcgaagccccattcgtcgcgcagaatctcctggagcaaatgcttgttttcgtgcgcgtagacgccgttgatctcgttgtaggaggtcatgatggtcagcggcttggcttcacgtactgcgatttcgaaaccggtcagatacagttcgcgcatggtacgctcgtcgaccacggagttgctggcctggcggcgcagttcctggctgttgaccgcgaaatgcttcgggcatgcggagatgccgttgctctggatgccgcggatcaggcctgccgccatacgtccggcgacgatcggatcttcggaatagtattcgaagttacgtccgcacagcgggttgcgcttgatgttcagacccgggccgagcagcacgttcacgtcaagatcgtgcgcttcgctgccgagggcctcgcccatttcttcggcgagcgccggatcccaagaattggccacggttcctgcggtcgggaagcaggtggccggcttggatgcgccgatgccgagatgatcgccttcgccgagctggcgacgcacgccgtgggggccgtcgctcatcacgaagctggggatgtctgcgcggtcgttgcctcgcgaatcccattcggatccaccggaaagcattgcggccttttcaacgaccgaaagttcttcgagttccattggttctcccttgcactaactcctcgaacccgcttggccctccctgagcctgcgctgttcttgttgcggatgttcttggctgcatcgcatgtgagcatccgccgctagtttgattgaaccagcctttcgccgccaatctgcgccccattacacaacctgtcgttttgcccgcacaatcggacattccttaactgatttcggaatcaaaggaattcacatggcagatacgtttttaccgctccgccgcgctttcgtatgcgttccatacacaccatacggcgtaggaaatgagcggacagatggtggcggaaataatcacgtcggtcggataatgcaagccgagcagcaatcgcgaacaggcaaccgccgcgacaagcgcgacagcgccgatgaccgccctgcggaggaacacccgtcttccgtttgcacgcccgtcatcttctccgtcggggaagcatttgcgcgcgaaattacgcacggtaagaatcatcatgaccgatacgatcaccgcggctgccgtgtgaccactcggaaaacttggatcgcccggcaatagatcactgccgacggacgtgatcggacgggggcgttcgaccagccatttgacaccggtcacgtacagtatcggcgccgccgacacgacgacatcgcggatgacgacgcgcctgctgccggtaatacgcaaatcgacagcggcaagcgcggcgacgattgcgatgcagcctaccgttgaaaacaaatacgcaagtaccgtagagcagtcgcgcaacccttctggcagcgccgctaaagcctgcaaaatattggtttcacgcattgtcgcgattgccgaattgcgcagtgcgacgccaatcataggcacaatgccgcacaatatggcggttgcgattaccacagccgccgctctcgcgatgcttccgttcttcatatgcatgatttcagttaagcacagttcaccataccgttgccgtatgttcacatccggggtatccccgaaaatcgaggattatccttcagggggcttccccgacacgcgcgctgcagacgtccgcgcaacacaaatatggcatacccacacgggaagtaccgcgaacgatgcgagaatcggaattggcgtttaagaaggaaagaaggaaatatgaccgaaccaatcgcaatgaccatacgccatatgaaaatcgaggattatccgctggtatacggactgtggacacgatgcacaggtttcaccatgagggatatagacgattgcgaggatgcgataaagacgtttctcaaacgcaatcccgacacctgtttcgtagccgaggacgatgacggaaggatcattggcgcgattcttgccggtcacgacggaagacggtcacgcatctaccacacggcggtcgaccccgacgcacgcggtaggggcattggctcgatgttggtgggccgtgtggttgaaacgcttcgtgcgatcggcctgccgaaagtcgctgtcggagtgcccgcagacaacgacgccggcaacgatttctgggaacggcagggctttgcagtccgtgacgatttggtttatcgagaactgccgttggaataacgaaccatccacgatgccgtgcacgtcgcccagcccacgttgttcgcggacagcaagtagaagccggccagcatgccgccccacccatggacacgtaggcagcggaggcgatgccgcggcccaacgcgttcattacgtggcgcagcagccacgtgtcaagaggcccctgccgtaacggaagtccgagaggccaccgatggtggatcgctgttcggacggaagacacggtttaggcgagcgagctatgccttggctagcttcttgtgcctgagagtgtaaacggcatcggcggaatcggcgacacgcttggaatgcgtcaccacaatgacacatttaccgagttgatgagcggcatgccgcaaaagatcaatcacctcatcagtcatttccggatccaggctgccagtcggttcatccgccagaatcgcgcggccgggcgccactagggcacggccgaccgccactcgctgacgttgaccgcccgacaggtgcatgatgttgcgcttcgattcctcacggctcagtcccaaatcctcgaggatcttcatatcggccttgggattgaccaaacgcagattctcttcgggagtgagatagtcgatcagattatggtcctggaacaccaaggacacgtgctcgcgacggtgctttgaataacccgtcgtagctatatcctcaccctcgaaacggaccactccatcagagggggcatccagaccggccaacagggacagcagtgtgctctttcccgctcccgatggaccggttatcgcatacatctttccggattcgaaatcagcgttcacgtccgaaagaacgcggatcttcgccgcgccatatgagtaattgacatggtccaattgcagacagatagtcatgattaatatctcctaacgcatagaggaaagaatggatttcggggatttggccagcaccgcggcgcacgacacggcaagcgcaatcgcgatgaccgcgcatccgagcagcaggatgagcagcgtctgttctggcggcagagcctccacctgcaatgattcaagaggcgcgactccagaatcgtgcagcagaagcgaggacacgtatccagacaatagggagcccgtgcccagcgagcacagggctgcgaccacagccatgagaccggtttcgattgcgaactgggcgataatctgcatcttgccgatgccgagagccagaagggtgcctatctcatgaatacgtgagcggatccagaagacaagcgccatgcccagtaccaacacatcagccaagcaaacggacaacagcaccatacgaaccagatcgcgcaccgtttccaccgactgcagcacaccagaaagccgcgccgagtcatcggtgacgccatacttgcttccagcgatttttttcgcttgggccactgcggcggagagagcctgcggattatccgaaagacaccggatcgtgccgacccgttcctctccagtcagcgcggaaaccacttgggcacccgcatagataagattctccgatgcgtccgatggcatagggctctgtgcctgcacattgccagagaagattccggccacgcgaacggtggaatcgcggtcttcctgactgagccggagtgttgatcccaccgatagcccattctcacgtgcgaaatcccggtgaatcagtacgttccggccattacctgaaatgtggtgtccttgttccaaccggtacagaccgctttggaactcttcggacaacgaggagtcagtggtgcccagcacgctgacctgcgtggatagaccggaatccagccgaggaccatgttcggggacaaccggatgcgctccatccacccctgccaaggtcttacgctcgtaaacggtttttcctacgccggggatgcgcgagaaccggctcgcttcctttagacttgcaggattctcgcctgtgtcgacagtaaaacctattcccatgcttctgccgatatcgtcggacattttctgaagtgccgttgacactccaacctgagccacaagactggtgaaaaccatcagcatcagcagtccgatgattccgctgcgtaccggtttacgcacgattgccagcgtggcacgattccacacgttcatgcccgtcatcggagctccgacaggcttcgcggcgacttgcgcagcatcggtatgcacgatatggcgacgcataccagcatcaccgccagcaggccgagcgacacatacagtacggcagtcgtgtcgatcgataccgtgagcgaatccaaggtacgaaccgacatattggattcgagatcgccgccaacctgccccatgctgctcagctccttcgccgcggaggcgttcacggaacggagggccgaagtgccaagccattgggccactcctcgtgcgcacaaccatccgagggccagggacggcagaccgatcagaatcatctcggttagatattgggcgatcagggatggcttgccgatgccaagggacaccagtacgcccatctcctgacgtcggtcgttcatccacagtaagagcatgagactgagaactatcacggccgaaatggtcacgccgatcaaagcgccgagcatcatggaacgcacacctcgggcggcattcagcatgctcgacgtatattggtcattgcgtgtgatctggtagctgttccaatccactggaagcttcttcgccgcttccatggttttctccacgtcgacacccttgtccagaacgaaagtggcatcctgatatatttccttgccggccttgtactggtacagagtacttgtagtgtccaaatcggtgtacacagtgttggaggtgagttccgcgcggctggatacctttctgtcgctgtctcctttgaatattccaacgatggtggttttgacggttgccgtcgaatgcgactcattgtcggcatcatatggattggccttgagcgtgagggtatcgccgactttaagcccattggttttggcgagatcctcatggaccatcgacatatgcttatcggatgccttgagatgacgtccgtcgaccatgctgagcgtgtgcgacgtgaacacattgagttttgacgaatcgtttgtgcccatgacgttggccgcattgccgaactgctgttctttctccgcatcgtaatcatcgccgccggggaccttcaccacgctggctcccacgagatcggcggtggcgttctgcctgaccatgtacgagtcaacaccggacagcttcgagattcgttgcacatcagcgggacgaaccattccgcctccgcgaggtgtcagcatgctgccttgcaggttactggccagcacgaatccgccgaccgcctgtttctcaatctgtccggcctcatgttgcgctgcccgagaaactgcggttgcggacagcatactcgccgttatgatggtcagcacaatgaacagcactgcggtgcgcactcgctttctgagcacatagcgcgccgctcgtgagatgaatgtcattaataccccctgtgaagctggggccttctcatccgaaacaatgaaatctaattcgattcttcgattggtcattcgccaaaatacatggttcacctcggaacatggcaagatatgccttgagcgaaaaaacgaaacaacattggttgcattatgctccgggacatcggtcgttttgttcatttgacaaactttgaacggctataaaacagtgcatataccaatggaagccccaatcgaaattggggcctccatcagagagaaaggaaggagtggcaagtattggttatttattcggtcagaatcttggccttctcgttgacgcttcaaccgtctcgaccgtcttgacttcctcgtcggggatctcaccggccgcgagcttggcttcgagctgctcgacgatttcggcgtgtatcttctcgttgatcttcaccttgaaggcgaacatcaggcggactccaccgtccgcggctgttgcgttgctcattttttcttctcctctaagagagttggagccgaaatcacccattgatcttgtattgcaatacgccgttttataaacagaagtaaaaaacattagtaatcaaagcttttgccgacgtgttgcaacaattcccatgatgcaaagcctatccgtcaccgacttaaacatgtttaatgggagtacttgaaaaacagagggaactgtggcggtaaatacgatttgcttttcggtaaaaaacatttatcattactggtaaaggaagtttagcttcctcatcattcacaacgaagtaatgaaagaaagcagaaaacatgacaaacagcaatcgtgttgagcacgcatccgagacgtggctgaccgacgcgactgtgttcgaggtcaaccgcacgccggcccattccaaccacaagtgtttcacgcatgatccgcagagcggtgagtactccgatctcacgcaaagccttgacggagaatggcgcgtcgagatcgtacaggcttccgacatcgacttcaacgaagagccattcgttgccgaaaacttcgatgattccgctttctaccgcacccaggttccggaccatctgcagatggcaggcctgctgaagaacaagtacgtgaatatccagtatccgtgggacggccacgagaatccgctggagccgaatgttccggaaaacaatcacgtggcgctctaccgcaagaagttcgtcgtgtccaagcgtcttgcggacaccaaggagtccggaggaagcgtctccatcgtcttccatggaatggcaaccgcaatctacgtgtgggtcaacggcctgttcgcaggttacggcgaggacggattcactcccaacgagtttgacatcaccgatctgctgcatgacggagagaacgttgtggcggtcgcttgctacgagtattccagcgcatcctggcttgaagaccaggacttctggcgtctgcacgggctgttccgctccgtcgaactgacggcacagccccacgtccatgtcgtgaacatgcagctcgaagccgattgggacgccgagtccggcaccgcctctcttgacgccgcattgtccgtgcgcaacgcctccgatgccgccaccatctcggccacgttgaaggattccgaaggcaacgtggtatgggagacctcgaccaacgccgacgccaacaccacgttcgcgagcggttccttgcagggcctcgagccgtggagcgccgagagcccatctctgtacgaacttgaagtcaatgtcatcgatcaggccggcgacattgtcgaagccgtcgttcagaaggtcggcttccgtcgcttccacatcgaaaacggcatcatgacccttaacggcaagcgcgtcgtgttcaagggcgcggaccgtcacgagttcgacgccaagcgcggccgttccatcactgagcaggacatgatcgatgatgtgattttctgcaagcgccacaacatcaacgccatccgcacctcgcactatccgaaccaggagcgttggtacgatctgtgcgatgagtacggcatctacctgatcgatgagaccaatctcgaaacccatggcagctggtgcctgcccggcgacgtagtcaccgccgagaccgcggttccaggaagcaaggcgcgttgggaaggcgcctgcgtcgaccgcgtcaacagcatgatgcgccgcgactacaaccacccgagcgtggtcatttggtcccttggcaacgaatcctacaccggcgatgtgttccgtgccatgtacaagcacgtgcacgacatcgatccgaaccgccccgtgcactacgagggtgtgacaaagaaccgcgactatgacgacgtgaccgatatcgaaacccgcatgtacgagcatgccgatgtggttgaggaatacctcaagaacgatccgcagaaaccgtacatctcctgcgagtacatgcacgcaatgggcaattcggtcggcaatctggacgaatacacggcactggaacgctacccgcactatcagggcggcttcatctgggacttcatcgatcaggcgatttatgccagccagccggacggctccacccgtctgtgctatggcggagacttcggcgatcgcccgagtgattacgagttctccggcaacggactggtcttcgctgaccgtactcccgcgccgaaggcccaggaggtcaagcagctgtactccaacgtccatatcgacgtgaccgatcgttcggtgtccatcaagaacgacaatctgttcatctcgaccggcggataccagttcgtgctgcgcatcctcgctgacggggagccggtatggcagtccgagcgtcgcttcgacgtgcccgctgattcggcatgcacgttcgatgtcgaatggccggtggatctctatcgcgccaatgccaatgagctgttgcttgaagtgtcccagcgcctcgccgaggcgaccgattgggctcctgccgggtacgaactcgccttcggccagactgttgtggccggaacgaaggcagccgaagacgcggccctgcctgcggacggcatcgtcactgttggccgttggaatgcgggtgttcagggttccggacgagagattcttctttctcgcacccagggcggcttggtctcctacacgttcgacggtcacgaattcgtgctgcgtcgcccggcgatcaccacattccgcgcgctgacggacaacgaccgtggcgccggccatggattcgagcgagcccagtggatggcggccggccgttatgcccgttgcgtggacaatgtcatcgaacaggtcgatgaagacacgctcaaggccgtatacacgtatgagctggccacgccgcaacgcaccaaggtcaccgtcgaatacaccgccgataccactggccgtctgaacctgcatgtggaatatccgggcgaatccggcgatctgcccaccattcctgcgtttggcatcgaatggactctgccggtccagtattcgaatctgaggttcttcggcgctggtcccgaggaaacgtaccaggatcgcaagcacgccaagctgggcgtgtggagcaccgatgcgttcaaggatcatgctccgtatctcatgccgcaggagacgggcaaccacgaggaagtccgttgggcggagatcaccgatgaaaatggacacggcctgcgagtcagccgcgcgaacggtgccgcaccgttcgctgtgagcctgcagccatattccagcttcatgatcgaagaagctcagcaccaggacgagttgccggctccgaagcacatgttcctccgtgtgctcgccgcgcagatgggtgtcggaggcgacgattcctggatgtctccggtccactcccagtatcacatccccgccgatcagccgatcagcctcgatgtcaatctcgaactgatctgacgatcggatagcgtgtccctcctctgcgccttcctgtggaggagggacgacatcgtcttgcaaggttccttcaccttggtgtaacaggtgacgatgcttcataacgcagaagatgcggcatagattcatgttttccatatgccgcgtcttctgctcacatcaggcctctttcgtatggttttcataaagatggcacgaaactgtccctgaccaccaattttgcggaaatcctcacgtgctggtttacggatcgtctggtggacagcgcttccgacagcataaacaccgcggccttagctaattcgtctttgttgatgtcgtacgatgacaacgcgggcgaggtatactccgctatctcttggttgttgatgctgaccatgcgtatatctctcggcactaggattccaacggacgcaaatgcttgaagtacgccgactgcaatcggatcggcagcaatgatgacggcatccggaaggtcgttactgtgcatttgtatgagtttttcaccgagagcgcgtccgttctctatggtgaacggtccttcttccaagacgagaccgttgatgtcaagtccgagacgtactgaccaattccggaacgcgaacgcacgggaatcttccggatactcatgatcgcccataatgtttccgactccgccgacgaaagctatgcgtcggctcccggaggcggtcagcgtatccaacgcgtccaaaacggtttgttccaaatctggttgcaccgaatcaaacaagtctggtgccggattaatatcgatgaatactccatgctgaaaagcattatgcaatcgtaggagcacatccttcccaaacggtgccggaccgatcgaaataaaaccagcatgcttgcccttattcttgatgagatcgttcacattacgatactcagttatatgcatgcgctcatcttccgcatgctggtagaggaacgccttgagctcgttggagtacatgtcttgcaaacctttgtccggaacggcattgtccaacaaggcgatgtcctgaggaatggtgacacgctggtatcgcggcacattctcatatcccaattcaaggctggcgttcagaactttttgacgggtggcctctttgaccgacagcgaggaatcgtcattgagtatcctcgatacggttgcaggggagaatccagccctttctgcaatctccctgattgtagccatgacaatctacctcctcttggtagacgaaagctaaacaaatttagtaacaagtttatcatgtttcgctttagagattcactggaaaatggcgggaatctctttttccgtcaaaaaagattgcggaccgtcctcccctattaggaaagacggtccgcaacatttcgtaacggatataacgcaatacgttaacgccggatggatcccttgaatggcttatccggagatagcgcgacacgtcccatatcagtccccagaacgttcagcgtaatctccgtgggcttcgaacagcgcaacgtatattccactgtctgatccgtccatgtcgcatccacttggattccgcctcttgcgcggagcgcatggaaggttccctcatgccaatcctccggcagggccggaagaatgcgaatccagccatcgtggctttggacaagcatctccgacaaggccgctgggaatccaaggttcccgtcgatctggaacggcgggtgagcgcataatccgctgtcgtacacgcctccgcccaacagattggtttcagcgttcgcatccaccggccgcaggaacatgcctatgattcgtttggcatgctccgcatcacgcagacgcgcccacatgatcatgcgccatacgatgctccagccggagccatcatcgccacgcacttcgagggatttcctagcggcttcctccaggtgcggagtcttagacgtgatgcctgcaccaggatgcagttcgtaaaggtgggacagatgacggtgctgtggatcggattcgatgaattcgtcgttccattcgaggattcttccatcagctcccaatcgcgtttcagccagttgggaacggacggcttccgcttcacggaccagatctctgtcctcttcgtcaaggttttccaaatcgtgagaagcctgaattaaatcatcaagcagattacgcacgatggccgtggcattctcactgctttgtgcaacggacaccggttctccgttcaccaagaaacagttctccggtgatgttgcaggggacggggccagtccatgctctgtctccgataggaaatccatgcagaatcgcgcgttgtcccgcatgatcggccagatgcgggccaggtacgatgcatcctggttgaacagatattcatcgaacaggttccggcacatccatgcctgaccgaacggccagaacgaccacatcgggtcgccgttcgcaggaagggctctgcgccagagatcgacattatggaagaccgccgatcctcggcagccaagaatcctgtcagcagcgtcgtgccccggcgctagcagctcctcattcatggagacgagcggctcgatgagttcttggagggcgcatgggcctgtcatccaatagttcatctcgacgttgatgttcgtcgtgtaggcgctgtaccagttcgggaaatccttatggttccaaatcccctgcagattcgccggctgggtgtgtggcctggatgaggagataagcagataccggccgaaatcgaacattgcctctgccagcatctccagacgatgcgattctttgttctcatccgagcgaaggatcgccgagaacagtagttccgcatcatcagcatgggctgaaccgagatggatggccaccctgtcgaaatatctgcggtagtccgcgatgtggcggtcgagcatggtctgcaggtcagtcgaccactcgtcaatggttttctccagatggtcggcgataaccgtcatgcttcgttccggctgctggtcgcttcccttgaatccgctcatactgcggaagcggagcgataacccggtgatgttcgaacattgcagactgttgtcgcccacgttgatgtcgccacctgttacggtaagggagaacgcaccggcgtacgccattccggttccgtcctgctcatcttcccaaggattttcggaagggtgaggcagaagtccgatgttgagtccaggcatccgacccatgacgatgagggtagcccgatggccgtcggataccgtttccaacgaagcgcgtgattgcttgaggaaagtgccggagacactgatattcacatcaatcggcgcatccgatgacatcctgtagaccaacaggtcatcaggctcgctgcaccatgcgtcgacatgaacgttggcatcacccatctggaacgtttcaccggcgagcgcccttgcaagatccagctggcgtttcatgctctcacggccgtctgcagaggtcgagtactgaatacgggccgttccgaatggctcgtaaatctgctcgtctttttcctgcagtgtggcttccttgatgattcgcgtggcggtggcgtaatcgtcatgcaacgacgcctggcgcgccttggccacaatctccggcgtcaccggcgaggtttccgcgtgtggatatcctgaccaaagggtgtcgtcgttgagatacagcacgtcggtttccggttcggagcacaggaccgctcccatgcgtccattgccgagaggaatgccttcttcccagcacgaagagattccatcgaatgtaagtttcatgcgtaaagtctccttggcagatttgcttatttgagaatgctctggatattgcggtactgttcgtcggtcagctgcacggcgggttcatggatggacgtgtcgattggcagtcccttcgccttgaccgcgcccttgatggcgctgatgaacaggtcggcagtgtcgtacaggcgcatcagataggaaatgcgttcagccgatttgatggccatggcgtaatcaccggactgccatgcatgatgcaggctgacgaaagtctccggctccacattggtcaatccgcacagcacgccattgccgccgctgattcggttgacggtgtagtattcgtcgaatccggacagcacgctgaacgatggattcaccttacgaacggcagcgatgaccttcctggtgtggctgatggtgtcgacggtgtctttgacgccgatgatgttctggttctccgctgcgagatccgccaccagctcgggtgtgaggtcgttgcccgtcctggctgggaagttgtacagaatgaccggcagcgtcgttgccttggccaccgcagagaagtagcgcttcgcgcaatccggggatggtccgaaatagtacggggatactgcaaccaatgcatcggctccggctacttcgctttccgccgccaatgttctcacattgtctaggttggtgtctcccactccgacgagcaccttcatgcgtccggcgactttcgaaactgcgaagcgcactgcttctgccttcgtcttgacgtcgatggcgtagaattctccgatgctaccgaacagcagcacaccgtcgatgcccgcatcgatgagatgatcaaggtgcttgccccaattgtcgtagtcaatggtcccatccgcgttcgtgatggtgatggaggggcagaacacgccttcgaactgggcgttgcaagtcatgatattttcctttcgacgatatggtaggcgtttcgcgcgttattgaggaagaagtcgtcattccctgcgaaacggttaagcaggattgacagatgactgtcgaaatcggcgtatagaccgacgacaggccaattcgacgcatacagcaaccgcttgttagagaacgcggcttgtgcgagatcgagcagggttgagacgaatcgtgggtcatcggttggataccccgataccttgacgtatacgtttggcagctctccgagcctatgcaaggcatcggatgaggattcgagattgtgaagatcggatatgttgcccatatggtcaacgatgacgattgcttcgggcacctgctcacaagcctgagcgagatcgccaagttcatccacccttacgcatgcgtcgaatggcatgttcttatcggccataagctgcaaaccgcggatgaagtcatcttgcaggcaccgtccccgcggcgatgccggcgtatgcaatggctcacgaacgccatgcgcgtacagcggcacgcgcatggccggcccgacggtggaccgcatagatgttgccaacagcagaggatcatggttttcggacagcagccgatcttccaatgacgtatcgtccgtgtcgacttccacatacacaccgccgatgaaattgaccgcagcgtctgggtggtgctcattgtatgaggcataggcgtgtttgaggcagtccatgtcgtaacggcgggtgatggacccatccgtaccgtcgagccatgaaagcggttggacggatggatcccagatatggaaatgcgaatcgatgatcctctgcatgtcgcacgtcctagtcgagtgccctatcgaggtggacgtatccgccgtcggggaagacccattgtccggtggtgtgcgaagacctgtcggacagaaggaaagccacggtgtccgcgatttccgaagtctcggtcatgcggtggccgagaggaatcctgtcggtgatcttcgccaactgctcacgctgcgcctgctcgtcgccgaacgtcttgatccattgcgcgtacagcggcgtccatgcttcggccacgacgacggcattgacccgaacctcggccggggcgagggcggcggcccactcgcgggtcaggcccagaatcgcacctttcgctgcggcataggcgctagtcttgccctgaccggtcaatgcggtcttggaaccgatattgaccaccgagcccttgctggccttgagtgctggcacgcactgatgaaccagctcgtaatagtgggtcagattgccgtgaagagactcctcgaactgacgccatgacgtggtctcgagcgcgaggttgtcgtttctgccggcattgttgaccacaccatcgatatggccgtatttcttcatgaccgattcaacaatgggggcgatctcatcggtgttgttcaggtcaatcagataggtgccatacgaatcggtgatctgttcgatatcctgtcggaattcgtcgtcggcaccatccgaacgattcagcaccaccggaatggcaccttcttcggccagtcgcagcgttatgcccttgccgatgcctttgaatcctccggtgacaataatcaccttgttcttaagatgcaggtccatctcaggtccttccgactagtccttgtgcaggtacttcatgcattcgtcgagcttcatctccgtgccgttgcccggagcgagcggcgcgacgtatcgtccgttcttgatgacggtcggatgtacgaaatactcatgctggttgtccacgtattcgacgacgcggtcctccatctcgccagagacggacacgtaatcgaacatcgcaagctggctgatggcttcgcacaggccgacaccacccgcgtgagggcagaccttgacgccgaacttcttggcgagcaggtattcgaggacgatttcctgggggccggcgactcgggtcgcgtcaatctgcatgaccttgaagctgccagcctgcaggtactgcttgtacatgactcggttctgcatctgttcgccggtggccaccggaatcggatcgatggccttctggattgcggcatggccaagaacatcatccgggcaggtcggttcctcaacccacgcgagatcgtagtccttgaatttgccgatccattcaatggcctgcggcacatcccagacctggttggcgtctacggcaatggcgatgtccggaccgaccgcttcacgggcaagcttgagcctgcgcaggtcgtcttcgaggttttgaccgaccttaagcttgatctgcttgaagcccatgacctcggtctcttgcttggccaaacggaccatcttctcgtcggaatagccgagccatccagcggcggttgaatatcccggatagccgacttccttgaggtgggcgatgcgttccgccttgccttcctgggcggcacgcagaatctcgatggcttcctgcggagtgagggcatcggtcaggtagcggaagtcgagagtcgcaacgagctcttcgggctccatctcggaaaggagcagccagagcggcttgccggcgcgcttggctttgaggtcccacagagccgaaagcacggcaccgattgccatatgctcgacacccttctcagggccaagccagcgtagctgcgaatcgcgcacgaacatatcccatgcgagacgcatgctgtcgagcagttcctcgacgttgcgtccgatgagggtttcggacatggagtcgatggctcggacgacgacatcattgccgcggccgatggtgaagacgaatccgttgccggaatcaccggcatccgtggcgatgacaacataggcagaggaataatccggatcggggttcatggcgtcggagccggagaaggtggccgatgtcgggaatcggaaatcataggtggtgactttggtaataacgctcacgatgcgcttccttctttggaaaaatgtttaatctcaaaaagggagggcggccattcggccgccctccctagcggtggcgggcaaccggatgtcagtcggcgtcagtggtgaccttaaagccgttgtcttccgcgtatgccttgagcttctgctgagccttggccatggcgcctaccagatcgccgttctcattcatctccggcacgatgacgtcgttgaacacgacctccacctgagacatgaacgggagatactcccaatcggtattgacgttatccatggaatcgaaatagaccgagttaacgtccgtattcgcgaagtatccatcggtttctttcttctcgcgcaccgtcttatcgtcctgatagacggaagccgccatgaagtaattgccgctgttggtatcctgccaagactggatggcgtccggagcggaatcgagccagttgatgaaggcaagggctgctgcttgcttttccttcgggcatgccgcagccacgctcatcatggagccgacggaggaggactggaaatgctggttgttccaggatggcggagttgtgaccaccatctttcccttgaggctcgggttctggtccttatacatgttgcccatccagttttcgctgatgaaggtggcataacggccatcgttgaccgaacggttgaactcgtcagtgtagacggtaccgccttcaaggacgccatccttcaggcacttctgcaagaattccgtgaattcctttgcttttccgctgttcatagtcagttcgacgtcgttcacggaattaaccttccacagacgcgctccaacggagcggtagaggttggtgaagatggagatgtcagatcccaggattcccatatacttgttggaatcttctttgtggagcttcacgccctcgttgtagatatcttcccagctttctggcacctgcaggttatgttcgtccaggatatcctttcgcacatagttggccaatggcgtggcatcctgtggcacaccgtaaaggccgccggcgtaatgcacctgagcccatgcagtcttggtgtacaacttgctccatgccttgtcgatgctgtcgttggcaaaattcagcaatgcgcccgaaaccgcaaactgctggaatttattagcgctcatctgtacaacgtcggggatgtctttattggcctgaacgacattctggaacttggtgaaatggtcggcagcggcaccggtgttgacaaatttaatcttgatatgcggatacttctcctcgaatgccttgacggtaggctccatctgcttggcggaataggcccaaacggtcagttcgacgttcttcgacgtatcggtcagagcgctttccacttccttcgcggtcacttcgctcttagcctggcttccgttagtgtcggaaccacatgccgagatcccggccgtcattgccagcgccgcgatagcggccacaagcctgacactcttcttcttcatgattactcctttgtgtgtcatgaattactattttgttgttttttcaaaaggacggatgccgcacggtcaccaaggcaacgaatgggtgatcgtagggaccgtgcggccgagggttcactgcttgacagaaccggccgcgaggccagactgccagtacttctgcaggaacatgaatgcgatgatcaacggaacaactgcgataagcgagcccgtgatgatgaggttgttcggaacctgaccgttggcagttccctgggcacccatcttcagccacatgttcagaccgactgtcaacgggtagtcgttggtgtccgagagcatgatcagcggcaggaagtaattgttccagacgccaaccagcgtgaacagcagtacagtgacgaaacctggagacagcagcgggaaaccgaccttccagaagatggtccaagtgcttgcaccgtccagtttcgcggcttcaatcagcgagaccggaatcgaggtctgcgcatagatgatcatcaaatacaagccgaacggcgtagccagctgcggaataatcacggcccatggagtgccgaccagaccgatcttcgagtacatgaggaacagcggcacggtgattaccgtagaaggaattgacatgaatgccaaagtgacggccagcagggcgttacgtccggggaatcgcatggtggcgatggcatacccagcgaaagtggcaatgatggttgcaccaacacctgcgaccgctgcgtacatgatcgtattaaacagccagcgggtataggcgccattctggtaggcgaatgtgtcttgcacgttctgccagaacacattcttgtcatcgaaccacagaccaaaagagctgaagatgccctcactggtctttgtggaggagaagatgacccacagtagcggcacgaggcagtagatgaccatcaaaaccataatgatgtgcagcagccagttgagcacacgctgcttgccggtcagcttcggagccggctcacgtcgctgcatgcgcttgtaacgcttgcttgccttaagcgccagtttggcgtctctgcgctgcagcgacttggaacgtggttttgcgattgcttcactcatcacttgttctcccacttgttgccgataatcttaacgacggcgaccaaggccatgacgatgatgccgacgaccagagagacggcagcagcatagttgacgttctgaccattgaatgcgaggttgtaggtgtagatgttcggcgtatagctgctgttgatcacgtccggggcagaagtacgcaagatgttcggttcgttgaacagctggagcgtgccgattacagagaagaggactgtcatcacgatggtgctcttaatctgaggaatcttcacggaccaagcgatgcgcagctccgaagcgccgtcaatacgggcagattcgtacaggtcgttcggaatgccgatcagtgcagaataataaatcagcatgttatagccaaggaagcaccaagtgcagatgtttgcgatggcgaatagcatgagctgcttcgacagcatattaggagccgttacgtcaagcatgccggcgatttgtccaaaaagaccatacttatcgccgtaaatgtatccccacatcagcgctgcaatgacgcctgggacggcataaggcaggaacagcagaattcgcggcactgcgatatggcggattctctgggagtccaagataagcgccgctacgagggacagaatcagattcatcggaatctgaatcgccgcgtaaatcagcacattcttaaagccgccccacaaagcctcatccttgaacgctcggatgaaattgtcgaagcccgcgaaggtggtgccaccgagaagggactgcttgaagaagctgagataaagcgcgtagagcatcgggatgatcatgccgaacaggaagaccaccacgtatggaagacaatacaatatgcctatgtactcgcgcttcggcttgcgcatcccggaagtatccggtttcgccgttgcatttgtcatagtttttctctttcttcttaacccgtctgaatgagcctgccaacaacatcgttgccattgccgtttcatccatcggtacgttcaatatacaaggttctgcaaaaaagagcaaataaaacttcgttatgcgtggcgaaattttctttatctttttttttggccttggaaaggctttattgcaacgatatatgcacattacatccatcaggcaagcagcagaagatcaacgtccacggcacacatttccgctatatagacagcaacacgccgataaaatatctatttcaaggtaacgaaaatttcgctatcctgtaggtaacgcttttttacagcgtgcatacgaaaagagaagagtcatgaccacaatcaaaacaacaagcagaccgaaggtctccgatatcgcccaagcggcgggagtatcccccgccaccgtatccaaggtcatcaatggccgcaatggagtctccgacgagacacgcgatcgggtggaactgctcctcgaagaagccggattccgcaaaaaacttcccacaaccaaaaccatgcggtcaatcgaactggtcgtcaacgaaatgaccaacaacggctccgtggagatggtcaaggaggcaacttcatacgccagagattttggcatcggcatcactgtaagctgcgccggaccggattccgaagaacacgcgacaagaaacgaggccagcagctgcctccgcagcgccatcgaacgcaacccactgggcgtcatacttctcttatcaaatatttcatcggccgaggaatcgctactgcagacgaggaacatcccatatgtaattgtcgatccggtcgggcaggtctccgctgacgcattgggggtgggcattgataactggaccggaggaatgctcgccacgcaatatctcatatcattgggtcaccgacggatcgccgtcatcactggccccaccaattcacaatcctcgcaagcgcgactgagcggatacatggcggcgctgcagaaaaacggcatcagcgcggatccgcatctcatcaaggttggcgactacgtatccgataaggcatacaaagcggcatgcgatctcctggaaatgagggaacaggaccgaccaaccgctatcttcgcgttcaacgatctcggcgcaatcaatgtctatcgcgccgcccgacagcacggcatcagtctgcccgaacagttatcgatcatcggtttcgatgatgtctatcctgcggcaagcatgtgtccgtctctgacgaccatcaggcaaccattcgacctcatcgccaggcaatgcatcgacctgattctcgaagcgcgggaagggaaggtggaacagaattacttcattcttcccacacaacttgtcgaacgcgaaagctgcacatcgccagcactgccgtaacatgcaacggcactgttgccatcctccggaagcaacatcgcattcgtgagatcacttccggaggagaccgtctatcatccgcttacccccgccgatgtcgttccggttagtccaatcgggaacgatgcggagacgctcgcatcgttcaaggatgatccgtggaccggcatggacggacgtcccgcgatcgtgtccaacgcgtacggcgatgagcgcaacgtgtacggcggagcacgtctgggccacaatggcatcaccaagagcctgccggctgacggggagccgatcgtcatgtcgtcggtcgagcgcgatggaacgattgctaccatcaacctcaatggcgtgctgatcatcaagaactaaacgccatcatccaatcggtggcttccagcttgttgcgggaagccaccgatttttcctttccccatcgaaaaaacaccgcaaaacagagccttcctgtgattaaaaaacgcagagttcctgaggactgggcttacccggccttccatgtatcgcgcaccaaagaccatttgccaataagcttttgccccccatgacgtaaccgtacagtcccgctcgaacaagcatttcgataaaatctaaaaactatcgaaatcatcgaaattatttgttgaccaaaattcgcccgccttaggatatcgactaccggccaagacgcccagacctgcactccgcgtcgatgccgcttaacagaaagaaggaaaacgatgaagttttttatgaagaagaaaatgattgcgctttgtggcgcagcggcgatgattctcccattggcagcatgcggaacgactcaggcggggaccaccgatgaacagggtaagacagttgtcaacgtttgggcttgggacaacaacctcaaagccaacgccaaagtattcatgaagaaaaatcctaacatcgtcatcaaattcacgaacgccggcagcggtaaagatgaatatcaggcgctgaataatgctttggaagccggcagtggagtgccggacatagctatgattgaatactatgcaattcctgaatacgcaattaagggatcactcaaaaatctgaatgattacgggactgccaaatataaggatttctacactcctggcacttggaacgcagtgaactttaatggcggcatgtacggcatgccagtcgattcaggcccaatggctttttattataacaaggaagtgtttgacaaagccggcatatccgaagctccaaaaacttgggacgaattctaccaagatgcaaaaaagatcaaacaaactggctcatatatcaccaacgacccaggaaatgccggattcttcaacgcgatggtttggcaggccggcggccatccatattccacgtctaaggatggtaccaaagtcaccatcaagctcactaccgataaaggggtacagaaattctgcgatttctggcagaagatgattgacgaaggactcatcgaaacgaaaactaaagatagttccgacgactggtaccgctccatcggttctggagaattcgcgagcgtgatttccgcagcatgggctccgggaatgttcctgaacaatgctccggaaggcgccggaaagtggagaatcgctcaaatgccaacatggaatgccggggagaacgttagctccgaatacggcggctcctcactcgcattgatgtcatcttcgaagaacgccgatgccgcgtacaagttcatggaattcgccagcactaattctgatgccatcatgtcccgagtgaatcagggtggtttccctgctgatttaaagaccatgtctaacgatgaattcctcaatcagaccactatggtgaattccgatggagacacagtggactacttcggtggagaaaaattcaacgctgaatttgccgaagcggcgaagcatgtcacttccaagttcgagttcctcccctacgacgtttacgcacgaagcgttttcaccgatactgtaggagccgcttacatggggcaaacaacaatgaaggaaggcgtgaaggcttggcaggacaagcttgtcgagcaaggtaagagccaaggcttcacggtgaacgaataaaggatggtaatggttggaatcaaggacgtggcagccctcgcaggagtttccatcagcacagtctcctatgtgatgacaggaaaacgtccaataggagcaaaaactcgtcaacgggtattacaggccgcacgtgatcttggatacctagcgaaaaacggcagtccagctccattgaatggagagactcatttcgttgcgttgagctcgcccgtccatgattccaccagctacaccaattattgcgcatattttctcaatttcctcaaagcagcgagacaacttggctatgaaacattgctgctaaccgaagaaacaggggatgagcagctgcgttccatcattgacaccggaatggtagatggcgtcgcacttatggatgtgaccatgaatgatccccggatagagttagctcagttttcgaccatccctttcatttccatcggacatcccatggatgaaataaacgtaccttgcattgataccgatttcatcgaaatgggcgaaatgattatgcagacgcttcaccgcaatggacatgacagaatactgtttataggagggaaaaagattgattatgaacgcgctggaggcgcgaattaccttattcgactgagaacatcaatgcatgccgcagccgcgcgttacggaatccatatagatgaagaatttaccgacaatgatgatttcgatgctgcagagaacctacttgaacggttcatttcagataaaaaaaatacagcgatcgtaacacaaggcgggccgttgttcttgaataaccttgttgcggcaacgagacagcgtggaataagaattcctcaggatctttcgttggtctcagcaggaacatacacggattctatgggtaaacgtctgcgaatagatgaattcccacttatgccagccgaattgtgccaactaggcatgaatatgctggttcatctcatggacgggaccataaagcgaaaggaaaacgctacactaatccatcccatatataagcaacgcggatctataacatcgctttgatgaagaacttgatttactaaggaaacaaaatatgactgatttcaatcgttccacccttcccgacaccgtgcgttccaacggcgcgaccccgaacccgtggtgggccaacgcggtggtctaccagatctacccgcgttccttccaggattccaacggcgacggcatcggcgacctgaagggcatcaccagccgtctcgactacctcgccgacctcggcgtggacgtggtgtggctctccccggtctacaagtcgccccaggacgacaacggctacgacatttccgactatcaggacatcgatccgctgttcggcacgctcgaggacatggacgagctgctcgccgaggcgcacaggcgcggcctgaaggtcgtgatggacctcgtcgtcaatcacacgtccgacgagcatgcttggttccaggcttcccgcgacaaggacgatccgcatgccgactggtattggtggcgtccagccaaaccggggcatgagccgggcactccgggtgccgagccgaaccggtggggttcctatttcggtggttccgcttgggagtacgatccgaagcgcggcgaatactacctccaccagttctctaggaagcagccggatttgaattgggagaatccggaggtgcgcaaggccgtgtacgggatgatgaactggtggatggaccgcggcattgacggcttccgcatggacgtcatcaccctgatctcaaaacgtctcgatggccacggacggctgcccggagaaatcgactcggaactatccgagggcgagatgggcgaagagggatacacggacgcaagcccgttctgctccgacggtccgcgcatcgacgagttccttgccgaaatgcgccgcgaagtgttcgaaggccgcgaaggctacat

SEQ ID NO: 82 - DNA, 59697 bp, Bifidobacterium pseudocatenulatum
atccgcacctcgcactaccccaaccaggaatactggtacgacctgtgcgacgaatacggcatctacctgatcgacgaaaccaatcttgaaacgcacggcagctggtgcctgccgggagacgtggtcaccgaggattccgccgttccgggcagcaagcccgaatgggagggcgcgtgcgtggaccgtgtgaacagcatgatgaagcgcgactacaaccatgcttccgtagtcatctggtcgcttggcaacgaatcgtatgcgggagacgtgttccgcgcgatgagcgtccacgtgcacgaactcgacccgaaccgaccagtgcactacgagggcgtgacccacaatcgcaagtatgacgacgtgaccgacatcgaaacccgcatgtacgcgcacgccgacgaaatcgaggaatatctcaagtccgatccgaagaagccgtatatttcctgcgaatacatgcacgccatgggcaattccgtcggaaatatggacgaatacacggctttggaacgctatccgcaatatcagggcggatttatttgggatttcattgatcaggcgattcttgtgcgcttgcccgatggcgatgaacgtctctgctacggcggcgatttcggcgatcgtccgagcgattacgagtttgccggagacggtattgtgttcgccgatcgcacgccgtcgccaaaggcgcaagacgtcaagcagctgtatgccaacgtgcgcattgtgccgggtgaaaccggcgttgagatcgcgaatgacaatctgttcgtttccaccgccgactatgtgttcgttacgcgcgtgcttgcggatggcgagccggtatggcaggccgaacagcgttttgatgtgccggctggcgaaaccaagcacttcgatattgaatggccgttggaggcctaccgaggccaagccaacgagctcacgctcgaagtgagccaacgccttgccgccgcggaagagtgggcgtcgaagggctacgagctgtcgttcggccagaccgtggttgcaggctccaagccggttgctgccagcgagacgaagcctgttgacggcatcgtgaccgttggccgttggaatgctggcgtgcagggatccggtcgtgagattctgctgtcgcgtacgcagggcggcattgtttcgtacacgcttgacggccgtgaattcgtgctgcgcaagcccacgctcaccacgttccgcgcgctgaccgacaacgatcgcggtgcaggccacggttacgaccgcgcgcagtgggtcggcgcaggccgttacgccaagtgcgtcaacaacaccatcgaacaggtcaatgacgatacgctgaaagccgtatacgagtacgagctcgccactccgcagcgcacgcacgtcaccatcacgtatgtggcagacaccaccggcaagctgcacttgagcgtcgactatccgggtgaaactcaggaagccccgaccattccggctttcggtttggaatggacgctgccggtcgaatactccaacctgcgcttctacggccccggacccgacgaaacctacgccgaccgcaagcatgccaagctgggcatttggaacaccaacgcttacgacgatcatgcgccgtacctcatgccgcaggaaaccggcaaccatgaggatgtgcgttgggctgagatcacggatgatgccggtcatggcatgcgtgtgagccgtcacggcgaatcagcgttcgcgctcagcctgcagccgtacagcgcattcatgttggaagaagcccagcatcaggacgaactgcccgctccgaagcacatgttcctgcgcgtactcgccgcgcaaatgggcgtcggcggcgacgattcctggatgagcccggtgcacccgcagtaccacattccagccgataagccgctccacttggatgtggatatcgagctgatctgacacgttggggcatgccggttgccccaacaattacggggggtccgcgtattctgcggaccccctgcttgcgttattgcgttaccgcgttaccgccaatttgcattggcgctcattgcctcatatcatgctcaccgctcaccgctgcggataggaatcctcaaagaagcgacgttcgagatgcacgatggtacggaacacgtcggcttccgagccatccaccgacgcatactcgttgacgagcgcgatcaggcgtcccgtccaagcgcggaaatgatcgccttcatgcaaatcaacccagcctttatgcgccggaatctgctgaacaacacccgcgtcgatggtgcgcttggcccaagcaagatagatccattccatgcagcacaatgcggtgatcagttcttcccacgttccctgaaccagcttggtgagatactcgcaatattcgcgatttgccggagtttgctcggaattattgtattcttcgtcggtaattccatattccttaaggaatcccgtaaaatacgtagcttcattatcccaaaattgtgcgttctcctcccagatttttttactttcctctgttcccatgttctctcccactccccaaatttgcttttttgcttccattaaatcttccttactatattccattgttaccctccataacttctgattgttgccgtcttgacgattatgtatctttacattaccttctgaaacatatggcgcaccttgtccaggcggctgtttggacggcggggctggatgaccggctgaccgacagcggcccgatatcctttcagctctgtaaggcatacgctccgcccgttggtgtaaaaggccagatcagtacggtatgcctgtatacagcgggcgggaatctcgccagtaaagacaacttcatccttttttacctgggccgtttcgatggtggcacagtatttcggtgcatcatgataagccctggaaaggtattcctggggcgcatagaggatgaaggagagataaggttccagcagctgcgtccccgattccttcaatgcctgttccaatacaatcggggccaatgagcggaagtccgccggcgtgctgaccggactgtaataaagcccgtattcaaagcaaatcttacagtccgttacgttccagccgaacaagccctgctccagcccgtaacggataccatccctgacagcgttttgaaaactctggttcaagtatcccagcgaaacccggctctcgtattgtacaccggagccaagcgagagtggtgtaacagacagtcctatggatgcccaaaacgggttgggcggcacctcgatatggatggtgtggctggctgctttgagcggccgctccatataaatgacggagggttcctttaccactgtttcaagcttgtatttttccgacagcaaagcggaaacaacctccaactgcacccggcccaaaaaagaaagaatgatctcatgggtgatggaatccacttcgcaacgcaaaagcgggtcagtatccgcaagttgcgtaagagcgtccagcagccgttctctttgcgctgccgttttcggcgcaatcgtcgtccgcagcatggggagggggtcctcgcgccaccttttacgagggagccgggtttggtcccctaatacatcgtttaacctcacgctgtcgctgggaaggataacaatttcaccctgataagcggtgtctgtccgaacaatttcccctttggatggaatacgcatctctgtgattttcagcttttctctcccggccagggccaccgtatcccgcaggcgcagcgttccgctgtataaccgtagatagacacgccgctggccgcaatcggtgtactcaaccttgaaaacgctgccgcatagggcggcgccccccctgttccccaatcggttggaacagccctgtcaccgcatccatcaacggttgaatgccaaggccatttttggcgctgccatgatagactgggaacagggaggcgtcttgaacccgctgctgttcctcccgcgcaagtttttcccggctgattggttctcctgcgatatacttttccaataattcatcgttattttcgatgaccgcatcccatgcttctatgtcggtattttcctccaggactatttccggggacagcgacaccgtctgcttgatgataatatcggcggagagcttatcccgaacagactgaaccacgctctgcaaatcaacgccagcctggtcgatcttgttgataaagataacggtgggaatgttcattttccgcagggcatggaacagaatacgggtctgggcctgcacgccatctttagcggagatcaccaagatggccccatctaaaacagccaaagagcggtacacctccgccaaaaaatccatgtggccgggcgtatccacaatgttaactttacatctgtgccactggaaggaagtgactgccgcttgaatggtaatcccacgctgccgctccaaaaacatggtgtccgtcctcgttgtccctttttcgacgctccccggttctgaaatggctccgctggcatatagcaggctctccgtcaaggtcgtctttccagcgtctacatgggcaagaattccaatattgattattttcatgtgattgtcctccctttacagccccaaagggcataaaaatccccagcagtaaaatacttttaccactggggattataagttgcggacatacacatatacagcatacacctgtttgtgattgctgtttttggggatatgtcaaaattgataaggtaaaagtattcttaaattgggtacaaaaaactaagcccctacaaaaggagctatcataatcctttgttcccactatttgattatagttttatttaagaataccttgccgcatattttttactccttttctggattaaatcattgtatcacatcagttttaggaaagcaagtacctaaaagaaatttttcttccccttatatgtaacaatcataccggcttcctagcgttcagaatgttttctgctgtctgctgtggtgtttggttggaattgtccaaccaaaagccgatccgtggtgttgtctgcattttactaaatacaaattcaatgtatacagaaagatataaggagtgggagggattccgccgtagttggcattgtaggaaaatccaaaagtttagattttcccacaatgcttatcttttggtctttggttcggaatagtgtagtgctggcggtctatctcttgttttcggttgcttgcttccttaccgtacatgagcattcatggcggttatgtcatgaatcagcgcttcgtcgctcggcgcggtcagcaagccgtccggccaatacccctggtcgagcacacccttaagaaacagcggtttgccgttgagatggaatcgcgcaacacccttcaaatcaggcttgatttcaaccgtgcggaatgcgcaatacgagcgcacaatatcttgcttttcttgcgatgtcgcagcgccaaattccaacgtagccgtcacgtcatacaaatacggatcttcaggcgaccataagtgctcggcccgcgttgcgatttccgtacgcaccttgcgcatgccggctgcaaaccgctcgtccgcaacaatcgttccatccgcagaatccgttacgacgatatgcagtttggcgttcggcttgtctccgccgatttccgcgcgaatgaacagtctgccgtccgcagagcccttcagcgtgagcgtctgcatgtacgcttccggcacgatctccatccatacgctctgccaaatgccgctttgcgcggtataccaaataccctcgcgttcgatcttctgcttaccgcgcatctgcgtgcccgaatcgttcggatcatacacgcacaacgcaatctcgaaagcatcatcgggatcgacgaacgccgaaatatcaacatcgaacggcagatagcccccgacatgcacccccgcaaactgcccgttgataaagcaggcacatacgtaatcaaccgcttcgaaatgcagaatcaaacgattcgcatccccgatctgtcgaaccgcttcctctctcccaagagtgacagagtgcacaatcgtgcgataccagatcatattgtcgggataaatcgtttgatgcacgccggaaagcgcggattccggggagaacggcaccaaaatcttgccgtcgaacgtttcggggatggccgcttccttcactgcccgcaccgcttcgtcacgggtgagtacagtcgcggatttgcgccatttcgagctattgccgctttcgggaatggatacgatcgcgtaatcccagaatccgttgagcatagtgtgattgctgcgcaccatggttgggcgaggatgttcgttcaggattggcgtgcggccgttttccagtttgcgttcgccatctttcgcagggcagaacgccttgtgggcgtcgttggaagacaaccattcgctgacaatctgctcaccccacgacgtccacaactgctgcagcggctcctgggaacgcattttcgtaggcgcggctttcagcactcgcttgacgtccaacataagagcctccctgcagcatcgcatttccctcaacttccccattgtaacgagaggaatggcaaagagaaatggcgattgttacggattttgaaatcgattcaatccggattgcactatagatttgtaaaatcgtatacagaaagtcgaatattgcgcattagatttacaagtcggatttgcaaaatcagatataaaaagccggtgcaagaacttcgtaattccttacaccggcaatcagaacaactcaccttagcggcaaatcaggccaaatcaagccgaatcctcaggtgaatcagcgaatcagccttccagcttggccttttcagcggcaagacgagccgcttcagcctcacgacgagccttcagttcggaatcgaagcgggcaagctcctcttcaacggcctccggcggaatcttcgcgaaaatcggatgcggcttcggcaccggagcgccggccacgatcggctcggaagcccacggatgcacggtttcgcccagcttgtagtcgccggtgatgatcgggtacatgaagcccggcttgtcgagatcctcaacctcttccaagcgcggcagcggcgagaacgtgcccgtgccgccaagagcctcccacaccttctgcgcagaatgcggcaggaacggggccagcaggtggttcgcatcagacacggcctgggcggcaacgtgcagcacagtgccgaggcgagccggattgtccttgatcttccaaggttcagtggcggaaatgtacttgttgatgtcgccgaccacgcgcatggcttcgctcagcgcgttcttctgacgatgattctcaatcagcgaaccgaccgtgttgaacgcggccttggtttcgctcagcagagcgcgatcctcatcggtcatttcgttctcgtcgagcgccggaatctcaccgaagttcttgttcatcagattggccacacggttgacgaggttgccccaggaagcggcaagctcctcgttgttgtggcgcacgaactcagcccatgtaaagtcggaatcggagctttccggaccggccacggaaatgtagtagcgcacggcgtccacagggtagcgggcgagaatatccttcacataaatgacaatgccgcgggaagacgagaacttcttgccttccatggtcatgaactcagaagccacaacctgctccggcatgttcagcgggcccagcttgcccgtttcgccgcccttggatccctggccgttgtagccgagcatttcggacggccagatctgggagtggaacgtgatgttgtctttgcccatgaagtaatagcccggggtttccggatcgttccaccatgcgcgccacacttctgggtcgcccttgcggcgggcccattcgatggatgccgacaggtagccgatcacggcgtcgaaccacacgtacagcttcttgttcggattgtcgatccagccggcaaccggaacaggaatgccccagtcgatgtcacgcgtgatggcacgcggcttgacttccttgaacaaaccgatggagaagttgatgacgttggtacgccagccttcgcgggtcttcaaccatgcgagattggcttcggcgagcgccggcaggtcgaggaagaagtgttcggtttcctcaaaacgcggggtttcgccgttgattttggaaacggggttgagaagctcgtctgggtcgagttcgttgccgcaggcgtcgcactggtcgccgcgggcgccgtcggcaccgcagatcgggcaggtgccttcgatgtaacgatcaggcagggtacggccggtggacggcgagatggcgaccttctgggtgcccttgtagatgtagccgttggcgaggcactgcttgaacagttcctgcaccacctgctcgtggttgccggtggtggtgcgcgtgaataggtcatagctcaggccaagatcgcacagatccttggcaatcacgcggttgtaacggttggcgagctcctgcgcgctgacgccttccttgtcggcttccaccagaatcggggtgccgtgctcgtcggtgccagacaccatcagcacgtcattgcccttcatgcgctcgtagcgcgcgtacacgtcggagggcacgccgaagccggcgacgtgaccgatatgacgggggccgttagcatacggccaagcaacattcaccaaaatatgactcatggtgcccgattatacaaagcgccatatcccgcattttccatgtatttcggtagttggatttttattggaggatggacgtgcgatcatcgatttcaatcgtttgaaatagtttgcatcataatttgcatatctgccgatctatccacattgttgcattacgtaacaatcattttccacatatccacagattttcgggggctggtggcgcaacggaattcgaatccgctacggtaccgtcatggacactccaccaccccttctgggcaacgatgaccttccgggcccgatgtgcctgaacctgctggcctcatccggcgcgctgtgcaagctcgacagcgtgaacgcctattcatgccacgattcggacacattgtacgggcggtcctgcatcatcgcgacattgctgccgagccggtccgtggcatgttcacgcaccgccgcatgggtttggctaggcggcaccttccccgaatccatcgacattatcgcgaaagcccactatcgagcgctacgttacggccgtaaaatcaacgttttcaaccgtctcgcaccaaacgaacacaccatcaaagtcggtccgatcatcgtgaccacgcctgttcgcaccgcatgcgatctcgcattgaactgcacccccgaaagcgaatcgttggtttccgaaatcatctgcatgctcatgcaggaatttcatttccgctccaacgattgcatgcaaatcatgcaggagacgaagcatattcgcaacgcgccacaggcgcgcaactacattcttgcgatcgacggaagaagcgacgaatatgagcgcagcgcatagcaggcataaggcgcggcacgcgacgcacgccgacaggataggtgccggcgggaaagtcaacgacaggataggtgccgacagaacaaacggattccgcagactgctcggaatccaagaaaaacgcaggccacggacgcatcgagcgacgcatcgggatgcgcggaatctcgcgcaccgtgcacagcggacgtgccgcgaaccgccgccataccagcccaaaccgcggccgaaaccgctggtggatccgccgtctcccccaattccattgacgccgctggtggcgtgcagtccggacacaccgcaggacgtgctatggcatatcgcggaatacgcgccgcaactgcgcaaatggctggtcgccaatccttccgcaacaccggcgatgttggactatcttgcgcaagtcggcgggccggacgtggcccgcgccctgcaaatactgctggaatcgttggaatcgtgcggatcgcaagcatgcagctaacacttgcgcgacgggcaatcgcacgatagcaatcgccggacggtaaataatatggacttactgcttcatcgcaagaaccgcattgtagacctgcttgcgattggcaagcgagccgtccgcaaggggatgctcggcaacgacctgcgaaatcgcgtctttgatgcgcagattgtcttcctgcgcacggtcgatcgacagcaccgccaagtcttcgacgctcaacgatgcgggggcagcagcgtcggcctcctcttcggaagcgccggcaacgaccaacaccatttcgccacgcggcggctcgtcgatcacgctctggcgaatctgcgcgatggttccgcgacggatctgctcaaaatccttggtaagttcacggcaaagcgccatcttgcggttcgaaccgaacacgtcaagcaggtcggccatggaatcgtcgatgcgatgcagggtctcgtaaaacacgatggtgcggcgttcagaacgcagggtacgcaggtattgcacgcgttcggaatgcttgcgcggcaggaatccttcatagcagaagcggtcggtgggcagtcctgaaaggcacagcgcgtccagcactgcggacgggccgggagcgcaggtgacgggcagaccacgttcgatggcgcgacgcacgatcgcgaggcccggatcgttgatggtcggcatgcccgcgtcggacacgaccagcacggtagcgccggtttccacctgatcgagcagaccgtcggacttgtctcgctcgttgtgatcgtggtaggccaccacgcggccgttcacgtgcacgccgagacggttggcgagcgcgtagagacggcgggtgtcttcggcggccacgatgtcggcgcgttccaggagcgcaatgaggcgtgcggaggcgtcggccgtgttgccgatcggcgtggcagccatcaccaccgtgccttgcggaacgtcggttccgcacacgagggcgtcaagtcccgtaccagactgttctgttccagactgttccgccgctgtcggcgattctgccatctccgccgtattcaccattcccgcagttcccgttacttctgccgtattcgcactcaactcattcagtttcaagtccaacgtctcattcatgcgttccatgccttcagcctatccaacgcaaaggaaaacagccctccccgcgtcctaaacccccaatcgctggaacaatccggacacaaaacagaccctcagcggggtgattcccccacccactggaacaatcaccccgcttacagccccagtaacgtcccaaaacatccagacattggaacaattcggacgccaacaggcttaaaaacgtcctgattcttccagtgactggaagaatccgccctcctacaagactaaaagcgggcagattcctccaccgactggaagaatccgcccgcaaacgcatgcttacaccgcgcacacgtacttacctcgtgtacatacgtggcagcgaatcggccatgcgtatgaagctgttgcgcgcgaaagcgctgaaatcgcgcgcatacggcgattccggcagcggagtgccatatgcgcccgtgccagcagcgcccgaatcattgccccagaccgccggatgtgcgccggtcacggcatgcacgtcggaatccacatcgggggtaatcaccttgctggtttcgttttgatgaccgaacatggagaattttccggccgccgcatgcaacgcttcgagcagcgcccgcgattgccgattcagattcccatcaaccgattgcgcaagattttccgccacgattcacactcccttgtatttgccgtattcgcctagtcttgcattgccccaaccgctctcgcattgccttactgctgtttccacgctatcttccgcgccatcgaaacacactttcgtaccgtcaacatgcgcgattcgtgttcagcggccccactatttgatttgttgacctcacgattccgtttttcgccgccttttttcaaatcgtgaggtcaccaaatcaaaatcatgaggtcccctccccccaaaaaaaaccaaaatcgtgaggtcccaacgccaaatcacaatgagcgatatgcgatataccggatatatcgcacactctaaagccaaacagccaaacgccaaacaccaccaaaccaaaatcacccaccacagttggcactttgcgtccgtttgtgcagatttgccaaccgtcgggcattactaggcgccgcattagagggccactggtaggctgacattggttccgcgaggccaacccacacaaggcagcctgaaccacttaattttggacgtttagatgtaaggtactcacagagagcatttcatgggaattatcaacttcttcattaatctgctcaaggatccgcgcacggcgatcgccagctggatctccatgggcgtcgcccccacgcttggtttcatcttcctgattgtgttcgtcgaaaccggcgtcgtgttcttcccgttcctgccgggcgactccctgctgttcgccgccggcttcttcgccgcgcccgacgcccagaccggcgtttccgcactaccgctgttcgcgctgctgcccgtggtctggtgcgctccgatcatcggcgaccagtgcaactactggatcggccacttcttcggccgtcgcatcatcgaatccggcagagtcaaggctatgacccctgaacgcctcgccaaaaccgaaggcatgatcgaaaagtggggcccgctcgccgtgttcctcggccgtttcttcccgttcatccgcacgttcatgccgttcatttccggcatttccggcatgcgttggagccgtttcaccccgttctccgtgctcggcggcctgtgctggtccaccctgttcacgctgctcggctacttcttcggcggcattccggccgtgcagaagcatttcgagctggtcatcattgcgattctcgtgctgtcgctgattcctaccttcgtcggcttgctcaaagcaaagttcggcaaaaagaaggctgataccgcgaccgcggaagcctgatcttacgttttctccttttcttgcgattgcggtgtctttcgatttttcggaaggcaccgttttcgtatgctttcgcatgcttttcctgcaagggatattccgcaacacgcgaatctcgcagattgcattcgtacagacttcgtactagaatcgcgagagttgtcttgcttagcgtgttgctagacatgacttggggccgtagctcagttggtagagcgcttcgttcgcatcgaagaggtcgcggtttcgactaccgtcggctccactaagcccgctgcattcattccaccgcagcgggctttttcttttcctagccaccagacaaatctgccgtacgtaagcgagatggggcgaaaaatcaggcctgggatacgcgctgacgcacgaaagcgtcgagcgaggccgcgtcaatgccctcgtagcccttgatcgaggcgaactgcgggccgttggaattgtcgatctgcatgaacccggtctggccgaccgtcgtcgcgccggaggcgacggccgaacgcaggcccgacatggaatcctcaatcgcaatgcagtacttcatatcttccggagcgatacccaagcgacgacccgcctccaaatacggggccggagacggcttcttctcaacatcatcatcgccgcacacgtagcccgcaaacgcgccagccggcgcttgggcaaccagattctccgcaagatgacgcggcgacgtggtgaccagcatcgaaggaacgccagcgtcacgcagcgcgacaagcacgtcttccacgccttcgatccacggaatgcgctcgaattccttttgggcgacgtaatcgatcatgccctggccgatctcttcaatcgacagctggcaaccatgctccaccatgcgacgggccacatccggaaccggcgtgcccgaaccctgccaggcgagctcctcatcccaatatccgccatgcgcggctgcgattttcatctcaccctcatgccaatacggttcggaatcgatcagcgtgccgtccatatcccagaacacggccttgatcatcaggttcgtctcggtcatgatgttccttccctacgaccgtcggacgcggagcaccggatttccgggcagcgccgtccatcgcgacttccactgccatttcagcagagcggcaagacggcagcattcgcgagtcgcggcaaaacggcagacaacaaacaggcatacaagcgaggcaaacgaaaagcgcccggacggtcctccatccgagcgcttcccatatcgacgcaatacttcgcgcctacgtattcgcaaaatcatccgatttttttcacgaattatcggcaacccccatcgctataatccatgaaattcgaaaatttcacttgtatcgggagatttgaaattcactctccctgattttcactgttttccacagcggtttcagcggccttttccgcattttccgccttccagcgagcgatgcaacgttccacgcgcttgtatccgatgatcttcggatcaagcccggcctcgcggaaaatcgcggcaggcgagccaccttcggcatacctgcgcatgcaatcatcgcgaaactccttggagtaacaaatacgatactgggtgaccgattccacggcatccagagacccgagatacttgcgggtcttagctgtgaacgcaactcttggcactgtacgctcctaacctttcctgttctcgccgcatatcttaccccctcctccatgattattcatgggcaaagagaaccatctttcaccgaagcaccttgacgaccggaagaatgacagttagaacgcggatactcaacattatttcccacaacaacgacatcgtcgcaggaagcaatgcatttggtaaaactatataacaaaacaggcacatctgttgcaagatatgcctgtttttgaatttttttcaatgttttctgaaaatcagtcaatcccccaaagcacgatagacctagaaatcggctgagaaacgggtttacccctctcaatcccctcgttttcgcctgcgacacccccaccgcgcgtgtcgtacgcatcagccgcgacacgcgcggcctccacggactcgcgcgacggcagctgacgggcgtcgacctgaatctgccgacgccacatgcgagcgcggcgggaacgttcgatttccacaatgtcaccgtccgcatcggccgcgaacacgctggaaccggccggccggcgcaatcgctcgacttgccggcgcagctcgcggttctcctcttccaaggaaaggatccgcgcgatgccagccaggttgatgccttcttcctgactcagctgctgcgctttcgcaaggcgcgagatgtctcgcagcgaataccggcgagcgccaccgtccgtgcgttgcggcaccaccagccccaaacgatcgtattggcggagcgtctgcggatgcacgttggcgagttcgccggcgcgaccgaccgtgaacatcggcagttcgatgtcgaaaccaacttcatccgccccgtccagatcggccctgccggccacgatcgccattgcgcacatgtcgtacagcattttggcctgccgcgccgcacgggcttgggaggtccgggatgcgcgtgccatggcaatcagcgctccttggcaagttcgtcagcgaaatcgccgcactccttgtcgaattcctttgccgcatgcttgactttcaggctcggcttgtcgggaatgcggatttgcacacgcccgatcagatcgccgtcgccctgcctgttggccacgcccctgccggagatgcgcacttcggtgccgctggacgagcctgccggcactttgaaggtgacttcgttgccgtcgatatcctgtgcggtcactttcgcgcccgccacagcctgaccgacggtgattggcagatccatgatgatgtcacgcttgcgcaggctgaatttcggatcttcggcaacgttgatctgcaggtacagatcgccgttttttccgccgttacgacccggcttgcccttgcctagaatacggattttctgcccgtcacgcacgcccgctggaacatgcgtcttgaacttttttccgtcggcagacagtgaaaccgttgcccccttgaccgactggcggaaagtcagattgatcttggaattgcggtcttcgccatcttccggctgcgcagcctgctcgtagctgcccccgtaggggttgccagccccggcagggccaccagcgccgccaccgaacatcgagaaaatatcgttgatattcggattgccgccaccggtctggaagcggatgcgcgagccattgccgcccgtgccatacgctccagcgccagcgccgaacatcgagccgaaaatgtcggagaatgcccccgcgtcgaatccgcccgcaccggagccgccggcgaagcgcgcgccgcccatgccgaactgacggatggcgtcgtacttctggcggttgtctttgctgctgagcacgtcgtacgcttcggaaatgtctttgaacttttcctccgcttccttggtcttgttcagatcaggatggtacttgcgcgccagcttgcggtacgctttggtaatctcatcgtccgtggcgtctttggagacaccgaggaccttgtagaaatccttgctcagccattcattctcagccatgatgtgcctcctttcacgaggttgctgatgtcaaatgcctgttgttgttgaaatcgctgtcactgcgctagctctgcggggacgccacgaccacgcgagccgcgcgaatcacgcggtcgccgatacggtagccggcttccaccacggtgtcgacggtttccttctcggcctgcggatccggcttgtgcaggatcgcgtcatgcttggtcgggtcgaaatcctcgcctttttcgccgaacttctcgacgccgaacttttcgaacgccttgtcgattttggcggaaacggctttgaaggattcgtccatttcgctgtgttcgcgaatgcgatcgatgtcatcaagtgccggcagcagtgcggtcagcacgtcgatgatgccgtgctggcggaagcgttcctgctccttctgcgaacgattgcggaagttgatgaattccgcacgttcgcgctgaagggcttccaagtattccgccgcttccttcttggcctggccaagcggagtcagcgtatcttcaccatcttgcgtcgcaccatccgcagcatcgccgttttcttgcgattcggaagatgctgcgttcgctgcagttgctgcagaatctgcagaatcggaagttgcacttgctgcagaatcgccattattctgcgattcctgcgatgcaccggctgcaggggcggcctgcccggacaggttgtccatgtcgggcaggtcgttcagatattcgtccttgttgaagtcggacatgattacttgttgtccttgtcgtcatcgtccacgacttcggcgtcaaccacgtcgtcgtcagcgggagcggaaccggcggcacctgcggcgcctgcggcatcggcggcaccctgctgtgcgtagagggcctggccgatcttctgggcggaggtcatcagctcgctctgggcggacttgatcttctcaatgtcctcacccttcagggcttccttgagctcgttgaccttatcggtgacttccttggccacatcgtcggagagcttgtctttattgtcgttgacgagcttctcggtctgataggcgaaggattcggcctggttgcgggtttcggcgtcttccttgcgcttcttgtcttcggcttcgtgagcttcggcttccttgaccatgcggtcgatttcgtccttgcccaggccggaaccgccggtgatggtcatggactgttccttgccggtgcccttgtccttggcggacacgtgcacaatgccgttggcgtcgatatcgaaggtgacctcgatctgcggaacgccacgcggagccggagcgatgccggtcagctcgaaggtgcccagcggcttgttgtcgcgagcgaactcacgctcgccctgatagacctggatgagcacggacggctggttgtcttcagcggtggagaagacctcggaacgcttggtcggaatggcggtgttgcggtcgatgagcttggtcatgatgccacccttggtctcgatgccgagagacagcggggtcacgtcgatgagcagcacgtccttgcggtcgcccttgatgacgccggactgcacggctgcgccgacggccacgacttcatccgggttcacggactggttggcttccttaccgccggtaagctccttgacgagctccttgacggccggcatacgagtggaaccgccgacgagcaccacatggtcgatgtcggaaacaccgatgccagcgtcgtgcagcacgttgttgaacggggtgcggcagcggcccagcaggtcggaggtcatgctctcgaagtgggcacgggtcagggtttcgtccaggtgcaccggagtgccgtcaggggtcatggccagatactgcatggagatggaggtgctcgaagaggagctcagctccttcttggcctgctctgcggcttccttcaggcgctgcagggcgatcttgtccttgctcaggtcgatgccgtacttgttcttgacttcgccgacgagccagtcgatgatcttctgatcccaatcgtcgccgcccaggtggttgtcgccgttggtggcctgcacctgaatggtggagaagccgtcgtcgtccttgccgatctccagcagggacacatcgaaggtgccgccaccgaggtcgaagaccaggatggtttcgtcttccttgcccttttcgaggccgtaggccagtgcggctgcggtcggctcgttgatgatacgcagcacgttcaggcctgcgatggtgccggcgtccttggtggcctgacgctgagcgtcgttgaagtatgccggacaggtgatcacggcgtcggtgaccggttcgccgaggtaggcttcggcgtcgcgcttcagcttcatcagcacctgtgcggagatctcctgcggagtccacttcttgccgtcgatttcaacggtccagtcggtgcccatgtggcgcttgacggagctgatggtgcggtcgacgttggtcacggcctgacgcttggcgacttcgccgacgaggatctcgccggacttgctgaatgccacgacggacggcgtggtgcgagcgccttcagcgttcacgataacggtgggctggccaccttcaagagttgcgatgcaggaattagtagtacccagatcgatgccaactgcgcgtcccataacttgtctcctttgtagataggttcgctatgcgttttctgttctattcgttctttcgcccgagtttcggtttgccgcctcccggactttccaaaacttgagcctacaccactcaactttgaatcgcaagcgattattcccaaatctacaaaaaagttgagctcccttcgctcaactttttatcagacacaatctcaagacacgatttcaaggcgcgatcaccatcgaacatcaatcaaatcgcaatctcaacaaaacctgccatctcaccatcggcagggcgcgaacgcaatccgtcaacgtttcaactgcctttcgttgacgaatcgccattaactgcaatcaaccggccaaatcaggccgcaccggaacccgcgttcggattagccagattggcggcgaccggcgcgagaagcacacgacccgtaccgcgatacacgttgaccaagccctcgccgctcgcagccgaaccgatcagcgtcttcgtggaacgctcgaccgtgaactgcaggccgttcgtccacgcgatcgcgaaattgccgtccaccttcagctcgtcgttctccaaatcgacggtcacgatttcggaagcgggcaccggcgactccaacgcaaccgttccctggcccatcagcgacaggttgaacaggccctcgcctccggccaccatcgcgctcggacgcgaaaccataaccgcatgctgctgaatcgtggtttcgcaagcgtagaacaggccgtcgttcacggtgatggcgccgcccatctggctcggatcgagcagcagcacatgacggtaggtcggttcgagcacaaccacgccattgcccacgtattccggcttgaccgcggactcgttggtgaccgcgccacgcgccagcttgccgatgaaatcgccaacgcccttcacaccggtcgtcacttcgacatggccgacggtccactgcatggcgcccgcctgcacaaccgcgccggtcttgccattgagattgcagaccagttgacggcggcgcacgttcatttcggacgcatagtaggcgtccatggcgctgccgtacgtcacggaaaaatcgcgcttccactccatgacctggaaaatgccctgctgcgcgacaattgcggcatcgtcattatccgtcagattgtaaatacgcacgaatgctcctttgctggtaatactttgttgataatactttggatgtcgagagataatctcccggtttgcgagatagacatctcgaaggatattgtctcacaacgcttgctgcgttgaacgacccatctcattttggatttgcggcccgccctgtctgcattgacctcacgatttcgatttggcgacctcacgattcggaaaaaggcttaaaaaatgaaatcgtgaggtcagaccacaaatcgtgaagtcaccaaacctgaatcgtgcgatgaagcaaaagatccggaccacactgcaatgcgtgcgatccggatcttatttgcgctcttcagatctcttcagattttcagcggctgatcttggcggtcttgacgatcatcgcgattgcggccggatcgttctcgacggtctggtagcccatttccttggcctgctcccacacggtcttgccagcgcattcgccgccctgcacggtctggcggaagtacttggaaccaccgccgatggtcacgtcagcgcgggtatcgagcagctgctcggaaatggaaccgatgccgccgttttccttgagctggctggcgaggcagcgcttgagcgcgtcgttggagctgccgtcggtcttgccttgcggaccgtagcagccacgctcggtggagtgcgattcgagcacggccggggtggtgtactggccggtgccggcattggtgtcgccgagctctgccggctggccgactgcgtcaaggccttcgaagtggccgtttgcacccccgagataatcgcgggcgacggtgatttcggaatcgcccatgccgtcaccgatgaacaggatgacgttcttggcggtgccgttgccgatggccgcaatgcgctgtgcgccgccgtgctgagccagttccgcaacggacttgccgttcagattgtaagtggaagtttcgttggcgagcgccggtgccgcaagcgcgccgagcgttgcaacggaagcgattgctgcaatcgctcctttgagagcctttcgattgctcatcttttttcttctttcttcagcctgtgctgtattgcaatctccacgccaggtttcgcaaaccaacttccgaggcgttttggacgaacaaaacgtgaactctcgtcttcacaaagtgaacacttatctcaaatcctctttccgtcaaccatcattcccaataccccctaaatactgaattatgactcatgcttttgtcgcatgaagggcaaacggtcaggcaggggtgcggcgcgtcaggcaggggcgcggcgcgtcaggaagaggcgcgggcggaacgagtggccttgacggctacgaagaggctgcgaatcaggagcacgcacaggtagcaggcgaacagaatcgatccgacgcggggcgagaccgcgcccgctatccacgtaccgaatggcgcggtaacggcagccaccaagccaataatcagcgcggccttcacatgcaccagccttcgtttcaggtttgccacgctcgtcgtgatcgagttcggaaacatggccagcagcgacgtgcctcgcgcaatcagatcggaagcgccgaacagcatcgatagcgcgggcacggcgagcgccccgccgccaatccccagcagtcccgccaatatgccaatcaccacgcccagcagcaccaggcaaactccggtcagcgcactcatcgcaatgtgctggtcgcgcgacggcacaaaacttatctggttcaccaccacaaacacgagaaacactacgaaaatccatcgcagcacaagttccggcaagcgcgaaagcagccagctgccaatctgcccgcccacaaacatgccgcaaaacagcagcagcgcggcgagccagtccacgtttccgcaagtcgcgtacgaaatgacgccggaaatcgaggtcggtacgatcgcaagcattgacgtcgccgccgcattgcgttgcgtcagtccgagccataccagcgcgggcacgatcacggtgccgccgccgatgccgaacatgcctgacagcagtcctactgccacgccgacgatcaccagcaccgcaatgcctcgcgcggattcgtcgagtcccacaggatccgcgccaaacagtcgatccgctttcccgccgaatttcccgctcggttgcacactcgatcgcacactttcttcagcgcgttcaacactttcagcattcgaaatattggaaatatccgatttcttcatctctcccctaccatcgcactttcttcatcttgcgataattgcgatagtacattcccacacatcgcagcgtcgcaagaccggcagaatacgagaaggaagaagagaaactacgcccgtctgccggacgagtggcgcccggcagccacgcgatcggctttcacgatgcgcccgcgccgccacagccgtgccagccatacgcacgcgaatccaatgatcgacacgagcagcccaatcacaagagccgccacagccgtcatataccccggctcgtcgtacgtggtcgcgtccggcaccttcgggttcggtatgcgatgcccgcgcacgagcagcctgtgcgagttcaccccgtatggcgtgcatgtgatcagcgtcgcatagtctttgccggattcgatgttgagtttgctgatgtcgctcggcagcactacggaaatttggtcaacctggtacgtgtaggtttcgtcgagcacgtggaatgcgaacgtgtcgcctttttgcagttcgtcgagaccggtgagcagtttcgcgctgggcagtccggtatgcccggaaatcaccgcatgcgtggtttcgccgcctacgggcagtgacgttcccgccaaatgccctgccgcgatttgcagcacaccttcgctggtgccatggtagacgggcagcttcactttgatgcgcggtatggtcacgtatcccatgatgccggtaccggttatgtcaagcgtgttttcatatgtttgccgctgttcgtcggtaaggtgccagcggtcgccgttcgccgcgagcgcctcgttgtaggcgtgcgccgcgtcgagcatgtgctgtttttcttcgccggagagatcttcggtttgttccacgtagcttgccacggcgtacgactggtgcatgcggttccaccagtcgctaaatgttgggtatgcgatgaggcagatcgcgccgatcatgaatattgcggatattgcgattaatacgtcgagcagcgcgttcgacttcttcttcggtttcttcgattgttctgcagtttttaaagattttgaagttttcaaagattcagatgattctgaagattcagcagttcccgcagattcagaaacttccgaaatttcaaaagattcaaaaaactctgcagaggtatcagcggcatttcggcgcgcttcagcgtccggttctcccgattcgcttccgttataccgccgtttcacgctactgcttgccttcccgctttctcgcaatcctcactacgcctaagagtaccaatgctgcggcgcagatggcggctgccatccaggccacgctctgcaccgccgagccggtgtgcgcgggcggggtttcgggtggcgtgtgcgtgttggtgatggtggtggtgtcgccttccacgtcagagagggtggtgtacccgctgggtacggaagcttcgaccaccgcccactggtgtgcggaggaaagtcccgtccacgaatgtgcccacttgttggaatcgttgagtttcacttcttcgaataccacgccgtcacgcaataatttcacggtgatggattcgggacgcttgccgtcggagtcgttgcgatcgttccacactttgcgcacggtgcgttccagggtcggcttgagttgggtggagcattcggtttttggctcgatggcgagttcgcgtgatccgttggagacgccgtcttgcggcatggcgacgagcatgttggcggaagcgcactgccagtaggagtcttcgtcgggcgttccgccaacagcagccgcgccagcagcgccttcgactttcacgctatcggacacgaccagatacagcccgtcttccacgccggcgaacgtgagtcgcccggctttgtcggtttcgcccgagtccacggctgcggattcgcttgccccgttcgccgcgatgagtccggcgagcgtgttggccacgtcgcggtacacttgcgcgtcatatccggttactttcgaccagtcgatcgggtatgcggtggagtcggtgaatggtgcgacgggttcgaagtttgcgccggacgagacttgcccgactttgtataggcggaaggttgctcccggaatggcgaactcgcccgttccagcggttccagaatcggaagcgcctcccgcattagagtcagccccgtcattgcttttgtgttgatacgtaatggcgatgctgccgctggcagagtctgttggcgccgcaaccgcatcgcgagtggtgagtgcacagattgcggcggcacatgcgacggcagctgcgcagcatgttgcgacgatgcggcttgcgatcgtgtgttccttcattgccagcccctcttctgtggttctttctatgaaaactagaaatatcaagtcgcccccaacttgcgacttggaaaaattagggagtcaggctgaattctcgttagtttaggcagtttacaagggatttgaggcaatccagcctgacatatgtgggttcagttattgttcaattatttttaaattatgttgattgtgatgattccgctgttgccatgcggaggtaagtgcatggcaacagcggtttcatgtgtagttattttcagttatggtttttgattttcagttatgttgactgtgatctgtgagatcaggcgttgcggcgacgcagcgccatgaccagggttgcgccagcgagcacgaacactgccacaccagccacatacagcatcaccgtgcccatgccaccagtggatggcaggttggagcccttgacgttgacgacgtcggcggtcagagagccggcactctcgtcagcggcgaaggtgatctcgccggaggccgcattgccgttcaggctggtcaggacatccgtacgctcttcggtggtccactcgaccttgtgatcggcggtcacggtgaaggtgatcggcttgatggtgttgtagcccgccggggtcgtggtctcggtcaggatgtagtctccgtcatcgagaccggagaaggtgaaggaggtgtccttgcccgcggtgaactccttgacgagctggttgtcggcgtccttaatcttcttttcgagcttgaacgcggcgcccttcagagcttccttgttctcgttgaccttgttcacgacgaccttataggtgaagacgatgacgttgtcccacggggtctcgccggtcggggtgctctcgccgccctgctcgaagttcgggttgttggagaactggagcttggcctcgttcttgttgccctggttgccgagcacggcctgctcggtgagcgtggaggtgtagtcgacggtgatcacggagccgttcttggcggcggccacggcggtcttcaaatcggtgaacacaacctcgaaggtgcagccgtcggtaagaccggtggtcttgaccgtgtacttgtcagaatcaacaagagcgctgtcgacgtagaccttgacggaatcagcgttgaaggacaggcccgtctcctccatatcgtggaaggcgaggtagtaggtcttgtagtcggcgtagttgctcggcagggtcgccttcagctggaacgggaccttgtcgccgatgtcgtagtcggcggagtcctgccatccggtggtgtcgttggtggtgtcgttggtgtccttgaccttcttctggaaggaggggacatcgctcttcgggctgatggtcacgtcgccgacgaccctggtgatgtacagggtgttggcgtcgttgccgctcacggagccgtccttgtccttaatgaggtagtagcccggagcagcggagtaggtcgtgctggtcttggtcagtgtggtaatcggggtgctgtcgagcttggcgaacgtcttgatgacgtcgagcttgtcctgatcggtcttgccttcgacgttcacatcggtgagctgcttcagctcggcggcggtcacctcagtgcccttggtcttggcgccgttctcgccgtacttgacgttggagagcacgccgtcggacaaatcaccggtgaagatctgatacacctcgtaggtgtgatcctgatacttggtatccgtagggaacgtaattgtcggattggtggtggcagtcgtattttcctccgccatggcggtggaggcgccggcgactccggcgatggccattgctgcggatgctgccacagcgacgaggcctttgagaaccttattcattgttctccctttctttccttttccataaacttgttgaaatcttcgttgttttccaacgttttcaattatttttcagttattgagttattgcccagaaggcagtggtcgtttgttttacggaccatcccctcctcttctagacgtattcattgccgacgcctcctgactttcagggccagtccggccgtcgcaacggatgccatggccacaagcaatcccgtagccaaagtcttcatatttccgtcgccgcccgtccccggcaacaccacccccggctgattctcaatattgccgagctgggcttcaagcacaaccgtcgaatccttcggaccgatggtgaacttgtgtgcggtagtgtccaggttgtatccgtcgggagccacggtttccacgagttcatactcgccccacttcaggcccgccaacttgaactggcctgcggtagcgtcggaatcatatggatcgccggcgttggccggagtgcatgtagcatcgcaatccgtgatgttccaggtttcggcggaattcaaggctgcgaatgccgtcccgttccacacgctcacacgcttcagtgtccactgcgatccggaaagcttcgtgcttgtgcccgccgcaaccttcgcccacgttacggagccggtttcacgattgttgtacacggtttccgcagtcgcattggacttctcagcactatcgacgatcgtaaggtgaatttcttcgctcaccgaattcgagtcgattacaaacgtgtacgtcgtgttattggcggcgaagccgtcacgcttctgctccttcagcgtgtacacgccccacggaagcccctcaaacctgaacttaccggcagtggaatccttgtcggcatacacgccatcgccaccgttgtcggtcaacgtatgcgtatagtcatcgcccgacacagcaaccatggaagccgtttcagcattccaagcctgagtctgggtcagcgtccaactcgtgcctccaagcaacgaatcatcgttggttgcggacgagccgtcatcaccggtgtctttcttatcccaaaccacaacaccgttcttgcgatcgtttggaatcttattgtctgtcggaagattcgattcgttcgtcacaatctgtccatcgcgaaccacaatcgtgtatgtcgtttccgaaagcacatatccggtaggtgccttggtttccttcagcgtgtatttgccgttatccaggctgacgcggaacttgccaacgccggaatccaggtccgccttcgtcgagatcgtttcctcatcggcgatcggcttcgcgaagtttgctgcaataccgtccgtttcgccgctcttcagcaccgcgctgtacacgtgggcgttgatattgcgagccgcaaccgtggaaacattgcaatcgctgatggcgggaaccgttgttgtcagcgttcctttattaatggtcatcgcctcaacgtagccgcccgaagcataactactattcgaaccaccattgttgtcccagtcaccgctgccgaaatggaaagtaaccttgacttccttgctatccggattcgcaatctcgtatgaataccagtcgttgcatccgctaatggaagacatagcagggtcactgtttacatcgcttgtattccagttgtcgccgaccgcgtagtgaatctgcggaacacccgtcgcatagtaatacacgacagtggacttctgcttcaccgtaatatgcacggtttgcgacagattacccgcctttacggtgatgtcggcattgcccgcgctcactgcggtaacaagaccattgtcgctgaccgtggcaatgccagtattggagctttcccaagtcaaagccgtgtttgcaggctgcacttccgcagccaactgcaacgtgccattgtacttgagcgacacggtctgatcgacaagactggttttgttcgtatcgccatccttgtacagggtcagggaagctgcggaatcgttggtgacagtaacgttcagcgtgttgcacaccttgctgtcagacgcggagcagacggtgaacgtcgtgctgcctttgccgactgcgatgacgttgaatgtgccggatccttcagcggacgaaatacgagccacattctcataaccgtcggcaccagtccacttcacctgctggctggcatcgctcggatcgaccttcaccgtgatcggagcggtgtcgccgcccttgtccaacgtgaggtcggcgatcgcgttgccgtcagcaccaagcagggaaacgctggtaggcgtggtcgtgttgtcggtaatgttccacgtttgctgcggatcggtatctgttcgtgtcagctgccattcggaaccggcaagggcaccgctattgctcgtgccgtcaaccttcgaccaggcgagttccgtgccggcggtttcgttgatgatggcaccttcggttgtcagcagtttcttgctgttgtcggtgatctccgtaccgtttgcgtcatacaccttgacgattgtggttgcgtcggttccgccttccgcagtatcaatgcggtagatgttcgtattcttcgcatatcctgaggctgccgcctgttcgcgaagatagtaagttgcattggttttcagaccatcgacctgcaacgtgccgtcagcagaatcccaatcattgccgccgttgtcggtgagtgtgatcagagcgccgctgttattgattgcattttggagatttccatacactgtccaagtcgtgccgccgagcggagtcgcggtattgcccgcaaccttcttccaagtgatggatgcggagttgttgagtgcaccactccacgggaagttgtgacgttcctgatccatatcgatgatggacgcagaattaatatcaccgccattatgcttcgcctgagtggggttgtacatcatgaaatcgtcacccacatacacgcgaccattggtggtcacatgcgattcaaggctaccgtccggcaccataatgctgccgagcattgctgcggaaggatcgtcggacacggaagagttgaaaatcgaagtaacactcgcctggctccaattcgtaccatcggcatgaagcttcttcaccgttgcattatcggctcggccgcccatgatggtgactttctgagccgtggggaagttccacatcagcttctgggaaaccttcgaataggtatcggcattcgagtcagcgctatatggaatctgattattgttgccggtcttgccacccatgacgtaaccgttggaaatttctttcgctcccgcagtatccgggtcattatagttcgaagcgccgccccaccagaagcgccagccggtacgcatctgaatctcattgctagggccattttcgttcaccacgttgatcacaacggacgcatcgtccggaatattacggaaccaaaaatcaatgcccttatcagtattcagctcggaagcctgaaccgtaaatacctgaagcttggattccttgtctccagtgaacgtaatcagcttttcatcaccactgttgaagctcatctgcaacttgtatgtgctgaagttcttctcagacgaaggatgattagtgttccaatgatagtcggaatgtacatcatcgttgtcatacacggaatacttattccagtcatacttcttgcgttcgtaattctgctgcgctggagcatcgccatactcgacgccgccagtatccttcagagttgacagctgcttggaattggacttgaacttgtcgccaaagctgtcaatcgtgttgccctgaccgtccttgacattgctccagtccgcgtaattccatgtgacatcgctatcaggcgtggtgccagagccgtacttgtagatggaactgcacgttaccttactacaagaaggcatgccccacaatgtggttttattgcctccgacaacgccttggtaattgccgctgatgccagcgccctgcgtcgtgtcgatgccgcttgctgacgacttccaagcttgggcggtactcgcaccagataaattcgtgttggtaccctcgactgcgataatagtactgccagcagcaggcttgtactgtgcgccgaaagctacggtgccgatggtgaagaagcctttttgggcgcgctgcatgtacttgccgagaatgaaggtctgaccttccatttccgcagcccaagaaccgtgaatagagccatcagcagtgccggtttcaccgtctgtgggcgcgccaacgtagaaatctctgcctacgtatgtggcaagaccggtatccgcctcgttgacgtcagtagagccgtcgcccatatggatggtgttcgacgtggcgaatgcgccatcgtccttgctttgatcggcattggcgctgtaggtggggatgaaggcggtgacggctacggaggccatcatggcaactgcgactgcggcggcggtcagggagcgggcatgagagaaggcgcgggcagataccactcgcgctcccgagtaatgctgtggcgccgagctcctcgctccgcctctgagcaatctcttcatcatgtcccctaactgcacgaatcagacccccctcagacattccgactctaacacgacatcctttgcaatatgccatctacaggagtggcaactacgccactcaacctttttctctctcccgcaccttgtgggtacggctcaaaatgataacctttgcattcatgaaaatcactgaaacaaaaataccccccccccgatataaaggtggtaaaacctttgttttccagtaccgaagcgtctaatccgttctgccaactggagtttgaaatcgttcgcaaaaacgccgaggttacccctgcgatcagtctttgttaatccaaccgataccctccacggcgtgtcgcgaaacaaatgattgcaaaccgtttcattcattgcagaaattttcatgaaaataccccctagtacacccgtgtaccacaccccaatccccccgccgcccatccacacctaccgcctgcataagtccagtatcagggccgattccggagttgcgcagacgcagaacgggagttgtgcagacggcagcatatgcaaacacccccgtaccaccgagataaatcaaaacggcaagtacgagggtgccaagaaagaagaaaatcagcgatctccgccgtagacggagtcggtgccgcggagcacaagctgggcacgcaccacctcatacggattttcgagagtctcccccgcaatcagcttcacggccttccgcgctgcggcacgacccatggcgaacggatcctgacgcatggtcgtcaggttcacggtgtcggcatatgcggaatcgtcgaagccgatgatcgaatagtcgcgcggcgtgcgatgcccataccggtcaaggcgcagcacgagcggaatcgccatcatatcggtctggcagcaaatgccgtcggggaactcatccaacgcaagcagcgcggtcaacgccgaatcggcgaacgttttgccgcgcggcacggaaagcacgcgccacttgaaatcgtgcgtgccctccatggtcttgcatgcgcgaatgaagccctgcccgcgcgcatcgatcgacgaattgatcgaatcgactgcatcggagcgcacgtacacaatgtttttgtgcccaagattgattagatgctgcgcggacgagaacatgccgtcttcatcgtcgatggagatcgttgcgtcgaagccttcctgcgatggcgtgttgatgccgatgatcggcacatgaatacgctgcaactgctggatttcctccggttcaacgccgaacgacgttacgaacacggcgtcgacgttgcgtcgcaccggaagattcgtaaagaagtcacgcctgttctcaccggtatcgacatgctggaacagagagatgtcgtatccggcatcatgcatgacggaattgattccagcgaatacttccatattgaaccagctggtgatttcctcattcatcagcatggcgacacggtacgtttgccctgacttcagtgccgtcgcggaacgggagatattaaaatccaaccggtccgcggtgtcgagcaccttgcgcctggtacgctcggaaacgagctccggacgcgtgaacgcgcgcgaaaccgtcgaaatcgacactcctgcggccttggccacctcacgaatgccagccttgtccatgtcagcccctttgcagctcacagcatcatcgcacccctgccaacagtggaacgggtggtatttggagcgacgacgctctctcaatctgttttcattatagtgcgaacgttgtcaaaactctcgcaatatgatcaaatttcatgcgacagccgcgcaaatcagcaaaattaccggatagaaggcatagaacatccacttagtccatgaatgtttgtatccgagtttgccattgtagtagtgcacgaatgcaacaccgacgccaggcgcaatcatcatcaccgcaccgaacagaccggccgtgaacatcatggtgttttcacgcgagcgcatcagccagaaaatcagcacgaaaccaagcgtcaccgcacccaggctcatcagatgctggcgcagtccgacacgcaacagcagatcccacaatacggcaaccactaccagcacaatgtcggagatcacgagcatggcaccttggtagcgctgcgccacccatttcattgctgcgagcatggcgaaggcgatgaacaggccgaacaccggattctgcgagccgaaatcgaacggcttgcccgaagtggcgagatcgtacggcacttcggcgattagtgccagcaacagcagctgcacgccgtatgccacgcgattgcgcgtctgctggaagccttgcaccagcagccacgcgtagatcggcgcggcgaaccacgacaccacttcgcatagcaccatggccgtaagcgacgtcatgttgctcgtgtcggatccgaaaatcagtggcaccagcgtggtactgccggcggaaagcaccagcgccaccgcgccgattaccttgagctggaatacgctcaatccgcggcgctgctttttcttgcggcgcatgcccgcaaagccgatctggtcggtgacgtcggttccggagccgttttcggtgtagccttccataagtcctcctcgagttttcctcgattccatcgcgcaagcaatcatgcgcgcacgtaatcgtctgcgcacactgtgccacgtcacgacattacgccgcggtatcgcgttgcggcatcgctgccatatgcggagcttcgcgtctcacgcgcttgcacagcattccgcgcaatatgtttttcacgtaacccctgtgcgacatgtttcacgcgattgtttcacactatgtctttcgtgctttcacgtagctttactcgcatcatcttgccattgttgcaaaaatcctgcgaacgtatgctgcaaatgtatgcaacataccttacacgctttacgaaaggtgacccccgtaaacgtggcgcacgccgcgcaatacgcgcaacgcaacgcacgccccgcaatacacgagcagtacgcacgcaatgcgaaagatcaggcgttcagcacgtaatccagcaatccttcataatcggcacccttaaacgaacgcaccgcataactcgacgcatccggatcgtcggccggcgaaatctccgtgcggaaatacacgccgtcgatgcccgccgaacgcgcaccgacaatatcgttcttctcgtcattgcccaccatcagcgcatgcttggcggtaacgaattcacggtcgagcgccagcatatacaaatcgcgcgcgggcttgcgaatcttttcctcgctggagatgatcacgtcgtcaagcacgctggcaagtcccgtcatttccaactcggcacgggtatagcaggattgcgcgttgctgagcagcgccacgacaatgccggcttcctgcagtttttcgatcatttccagcgcacccggatacaggcggatcatgctggtgctaccctgacggaacgcccacgcggccttttgagcggcctgcggcaacgccagcaaccgttccgcctcgtcgttgcgattcatgagcagcgagcggtacaccggcagcacgtcgaactcgtcccacccattgcgaacgatggcatgattcgactgatgcagcatttcgcgcgcctcaagtttttcgaaacgttcacgcagtgcctcaaccgaatcgtattgcgctccaagctcgcaagcggtgtcatacaaggcctgccaggccgcgtcgcactgttcgtcggtacgtatgtcaataagcgttccatacagatcgaagaacacaacctcgtatttaggggtatgcgtcacgttttccatagcaggtcctttcatcggcatcgtcgccgctttaccggcggcggcgattgccactttgcagccgctgcccttgcaaaccaatgcgttacatgcgttatgcacgaggttaccgcaaccgccagattgcaaacgtatgcggtggcacgatcaaataatcgccatctcccgcactgatgcacgccgcggatgcgtttgtggacgaacccatgccgcaccatacgcgagacgactccgaaaccggcgcaaccgcagtcgaggcaacgtcaatcgcgccaatatgacgtcccggattcaccgccaccaagtagtcgccgacccggaacaccagttcgtcgccttccacgctgacgatcacacgatcgccgtcaaaccattccgccgagctcttacgcaaggcgatcagtttcgtgtaatactccaccagatcgcgcatgcgccaggcacgagtccaatcaagccaattcagctcgcgcgccgaatcgtacgaatcggaattgccgtatttcgtacgcgcgaactcctcgccagacagcatgaacggaatgcccgcggaagtgagcacaatgcccgccgccatacgattcgcatccatcaccgtggccatggccccggcaatcgcggaaccggccgaggcgagcccagcttccgaaagatcggcgtcatacaacgccttcggcacgtccacggaattctcgttgtcgccttcactaacggcgctgcccagcgatttcgcggcaagacttgcgcaaagcttgtcccacaaggtcagatcgtcatgcgcggaaacatactggatcacttgacccgcaacaccttccggctgtttgctggcacgccaggcgttcaccgcgtcgcgcacggaggccgcattctcatgcatacccccgttaacgtatccgggacggtccgagaagaacacatgccccttgatggcgtctcgcgtggtgtcgcaaaaatgcccgatgcgattatcaagctgcggcaatccggccttgtcggcaagcacggtgcccggcaaagccgcggtagcgctggccgaccacggttcgccatacataagaatgctcggcccacggtcggggatttcgtccaaagcggcgcgcacggcgttcatggtgtcgacgtcgatcaggcccatcaggtcgaatcggaagccgtcaagatggtattccctcgcccaatacgccacggattccaccacaaaacggcggaacatcgcacgttccgtggccatatcgcatccgcatccggagccgttcgacaacgccccgttcggcttgcggcgcaggaagtattcgggcacgatgcgctcgaaccagttgtcgggcgagaacatgtgattgtagaccacgtccataatcactttgatgccggcattatgcaacgcctgcaccatctgcttgacctcgcggatgcgcacggacccgtcatacggattcgtggagtacgatccttcaggaacgttgtaattgacgggatcgtaaccccagttgtatcggctgcagatcgtttcgtcgacggaaccgaaatcgtagatcggcatcagctgcaccgcggtaatgccaagctttttgagatacgacaatcccgtcggaaaatcaggatgaccgtccaacgtcgttcccaggtcggtgaacgcaagatattttccacgatgggattcggggaatcctcccgcgggatcgttgctgaaatcgccgacatgcgtttcccaaacaaccgtttgcgcaatcggcacttccggcatgcgatcggcatcccaaccttcgggatcggtgcgaggcaagtcgacgaccatgcttcgacggccgttcacgccagccgcgtgcgcccatggatcggcaacgcgatcgacggaaccgcaatcgcgttcaatcaaaaaatcgtaatataagccgtgtttattatcggcaaaatcgtaagtccaagagccatcggcctcgggacgcatcaaaaactgcccaattaaagcgtcgccgtcttcccccttggaaccgcgcgagaacaacctcaacgttattttctcggccgttggggcccaaatggcaaactgggtgccggattgcgaaaccacggcacccagcggccgttccagacaaagcgggaacggttcggcgactctcgtattcggctgttcgaaattgttttcgaggctgtttacgagcgtcattgcttcccctttttctaactgttatcagcccttgacagaacctgacatggactcctgatagaaacgctgcatcacgatgaacaggatggcgatcgggatggagatcacgaccgcggccgcggcgaagcgggcgtaccagttctggatgtattccttctgcagcatgagccacaggcccaatgccacggtgtagttggactgagtgcggcagatcaccttggccatgacgaagtcgagccacggggtcaggaagccgatgatggcctgatagacgatcatgggcttgcagatcgggatgatgatcttgtagaacacctggaaacgggtgcagccgtcaagcagggcggcctcatccaacgaggttgggatggtgtccatgtagcccttcatcacgtagaatccagcaccggaacctgcggagtacacaagaatcagcgccacggtggtcatagcgccgcttgacaggcccaaggccttcagaatgaagtagatggcggtgacggccatgatgcctgggaacatgccgagaatcagcacgacgttcatgaaagtcttacgcacgcggaagcgcatacggctcatgcagtacgccaccgacagcacgaagatcacggagatcacgcaggtgaagcaggcgatgatgaacgtggtcatgaacatcttcgggaagtccagcacgttgcggtcggtgaacagcaccttgtagttgtccagcgtccattccttcgggaagaaggagctggtgtacggggcggtgttcttgttaaaggactccgcgaacacccacacgatcggcacgagccagatcacggccaggatggcgaggaacaggtgggcgaagatgtcgccggtgatgcggcggatcttctggtcatgcaggaagccatggctttccactttggttgaggaatgcttgttgctcatcggaatgcctcctcattcttataggagccggaattgcggtaggtgatcagcgagaccacggccaacacaatgaaggtcatgatgcctatcacagcgccaaggttgtagtcctgcttatccacggtgagcttgtacagccaggtgatgagcagatcggtagagcctgcggaatcgcccagtggggtaggatctccgctggacagcaggtagatgacgttgaagttgttcacattgccggtgaaggtggtgatcaggtacggtgtgagcacgaagatgatgtacggcatggtgatcttggtgaagatctgccaccagtttgcgccatcgatcttcgccgcttcgtactgatcggcaggaatgttctgcagaataccggtgatctgcatgatggtgtacggaataccaacccacaggttgatgatgatgacggtgacgcgggcccaggtggcgttggtgaagaacggcagcgggccgtcaatccaaccccacgtctgcagcatgcggttcaccgcaccctgcggctggagcatagtgtgcatgaccagcagggatacgaactgcggaactgcgatggacatggagaagcaggcacgccaaaaacccttgaagtgggtggtcttacggttgatgatcatggccacgaacatgccgaagaagaagttcaggaaggtggcgaagaaggcccagaccaatgtccacaccagcacgcgtccgaacagtgccgcgttaacagtgccgccgctgttggagaagaccttggcgaagttttcaaagccgacccagtggaacagcacgaggtgcttgtggtcgtagctggtgaacgccatggagatcatgaaaatcaacggaagcacagtgaacactgcgatgcccagcgtaggcaggaacatcagcaggacatgagccttggcgtcgagcagttcgtgcacatcatccatgaagctcggagccttgccgttctcttcaagcagcacctgggacttgtatgcggaacgcaccgacatgacccacaggccgacgaaggccacgcagatcacgagggacgccacgccgtagagcaggatgaccacggaacgatccggctcgacatactgccagaagccgtcaaccagtttcttgccgcccttgttttcgcccaagcttggcagcttggacagataaccaacgccattggtagccataaatacgaagaacgcgacttcaagggccagcatggcaatgcccttgacgtactgcttgcgcacgatgtttccaagaccgaatacgaccgcggaaagcttggtgaacacatcaccgtgggtcagcgcagccttgaccgtgtacggcgacgggggaacatagtcagcgccctgcttccggcggcgcttcatttcccgaggggaaagagtcgttgctgtcatttcgaccgcctctctagattttgaacataaaaaagctttgcttccggacaaggggaaggagaatttgaaaaaccttgcccgggaatgcaaagctcggaggaggagtgagccattgcgccgaaagggagaaacaccatgactcgaagcgttgctcatatgcgccgggtggctggcgggattcggcaaaccagccacccgacgcttttcagttattggtattgggtttcaggatttcactcagcgatggtgcccttggtctggtcaatccagtcctgatacttggcagcagcgttgtccttggtgatttccttgttgaccagggccttgccgaaggtctcggccggggtccaccagtcgttcatgccagccaggccggactgcaggattgcggtgttggccatggtgtcagcctgagccttggcagcgatgtcgtcggtggtcaggtcggacagggaggtgtcgctcggcgggatctgacgcatctcgtagtgcagcttctgggagtcggtgttgccgaggtaggctgcgaactgagcggcggccttggtgttcttggcgttcggattgtaagcgacagccttggtagctgcgaaggacttcatctgcttcttctcgccgttcacggtgaaggtcggcagctgagtagcggcgtagttgtcgcccagggcttccttcacgtcagctgcggaccaggtgccggagaacagcacgtcggcggagccatccttaatggcggcaaggccggaagcgccgtcgtcgttggagaagttcggattggcgaccacatcgaccagataagaagtaatatcggcgccgtccttcgggaagaccatgcctgcatcggcgtcattgcccttctcgccaaacaggctcagaccatcatagaagccgttgatgtaccaggaattttgcagggggaaggtgaccttggccttggaaaggatggtgtcgaagtccttggcctcatcctcggtgatcttggacttgttgtagtacatgaaccacgtgttgtcggtgtacggcacaccgtagagcttgccatcggtaccggtgacggaatcgacttcgaggtcgccgttctgttccttcacctgcttctcggcgtcggtacccagctggccaatggccttggcgtccatcagaacgcccaactgatcggaagcgaacatatagacatcggccgcggcggacggatcggtgctgacctgcttggaagcgtcaccttcggagacgacgtcgttcttccaagtgatgttgtactctgggtgatccttagcgaagttctcttcgacctggcccagccaattggtatccttggcctggtcttcctgcggagcccacacgctcagggtgatgtcctcggtgccggaggcaccgctcttgccatcgccgtcggaggagccgccgcatgcagcgagcgggaccagcattgcaacagctgcggtaagtccgattgccttcttccaatcgatcttcattgacctttcctttcctcacataaccttgtgcatcttcagcgcaaccggtaccgaacgtctgatcaaactccgcatacgttcgcaccatcgtctttcaagcgggtgttgtccgtctttggagctaccggatgtgcatcagtgattgcaagtgtagcacagttttgccaacgtttgcaatctgacgttaagattgtttcagcagttgcaggaaaacacgtttattccaaggagacacaccgacatgatttccccttcgacacacccctgtccacaatggctctccaacgcgatcttctacgagatctatccgcaatccttcgccgactccaatggcgacggcatcggagacattcccggcatcaccgcaaaactcggctacatcaccgaccttggctgcaacgcgatctggctgaacccgtgcttcgattcgcccttcaaagacgcgggctacgacgtgcgcgactacaagaaggtcgccccccgctacggcaccaacgacgatctggcggccctgttcgcagccgcccacgagcgcggcatgcatgtaatcctcgacctcgtgcccggccacaccagcgaggaacacgaatggttccgccacagcgccgaggtggatcgcaacgagtattccgaccgttacatttggacggattcctggatttccggcggtgacggcctgccgttcatcggcggggaaacgccacgcaacggcacctacattctgaacttcttcaaatgccagccggcactcaactacggtttcgcacatccccagcgcgcatggcagaagcccgcgttcggcccggaggcgatcgccacctgcgatgcgatggtagacgtgatgagattctggctttcgcttggcgcggacggcttccgcgttgacatggcagacagtctcgtcaagcaggacgacgccggcaaaccgttcacgattcgcacttggcagtacatgttttccaagattcgtccggaatttccagaagccgcgttcgtgtcggaatggggacgcccgaacgaatcgctggaagccggtttcgacatggatttctatttggattggcgctgggacggcattccgaacggctacaacatgctgttgcgcaacgtcgataatccgttgagcagggatggcgataaaagctatttcaacgtggattcgggcacgccgatcagtgattttctcgagcagtacgaaccgcagctgcgcgaggcggaacacctcggaggcaccttcaatttcatcacctgcaaccacgacaccgcgcgcgtggcaccacgcctttccgagcgtgagatcgccctggcatactgcacgctgttcgctatgccgggcgtgcctttcatatattacggagacgagatcggcatgaggtaccgcgacctgcccaccaaggagggcggctacgtgcgcaccggctcgcgcacgccgatgcaatggcagagcctcgcctcgctcaacgcgagttatgcgacgccggccatcaccggcgggaactatcttccggtcgacccctcccctgacgcgcccaacgtcgccgactcccaatccaacaaagcctcactgtggtatacggtgcgccgcatgctgcatctgagagggaattgcgacccccttcaatcgagggcatccttccatccgatctcacgcagaaggctgttcgcattcgagcgttcgaccgatctggaacgagtgatcgtggcggtcaatccgagcacaaacagcgaacgtttgcaattaccgaatggtcactatcgaaagattttcgaaatcggcgagaccaaggtcgatttcaacactttgaccctcggtacgcaaagctttgcaattctgaaggcgaccgcatgacccattccgagcagtgccgtcgtcagcttcaacgaaacatgccgtcattaccatggcggcaacgccatcgcacttcggaaacagcggtggcaacgacggtaggacagcagtcatatccactttcaaacaccttgcaaacgataggcaaacagaaaaagcattttcactatctaacgtctataaagtagttaagaaatcgcaatacttcaacgtttacacccaataacacgcctattgaaaacgatgtcatcatatgctacagtacatagcagaacggttggcatacgcaccgaagcgcgccaatcgcgtggcaatgcagcatcatcgaccagcaacggccccggaaagaaggaacctatgacggcaacccagcaaaccgaaagcgcggaacgcatcgcacgaccgcttattcagctcgccaaactcaacggcatctcaacgtcgtatatcgaccagctcggcacctacgtggaaatccgcgacgaagtgctcgtctccgtacttgcggcgctcggcgtggacgcatccagcgatgaagcgatcgcggcatcgtacgaactcaccaagcagcgcatcgcagacacccttgtggaaccgaccatcgtgaagttcatcggcaaggaagcgaccacgccgatccgcgcgaagggccacgacgtgacgctacgcctgttgcttgaggacggcacgcggtatgagggcaacctgtgcatgtatttggccccgcagaccgacggctcgctcacgctcaccctgccggacgacattcccgccggctaccacacgctgcgcgtcaacgcgggcccgctgcacggcgaggcgcgactgatctgcgccccggcacgcgtaccgctgccgcctgcggttgccgaaaaacagcgttggggttggatggcgcaaatgtattccatccgctccgccgaatcgtggggcgtgggcgactacggcgatctgaagctgctgctcaccgacgccgccgaaaagtcgcatgccgatttcatgctcatcaacccgatccacgcaaccgcgccggtcgagccgctcgaaccgtcgccgtacctgccggaatcgcgccgattcatgaacgtcacctacattcgcccgcaggatatcgaggaatatgcggagcttgacgaggccgcgttggccgaagtcgagcgcttgcacgccgaagtcgctcccgccaacgacaatgccgacgaactcgacatcaactccgcgtggtggcacaagcgccaggcgctgcagctcgtgttcaaggtgccgcgttccgccgagcgtcaggccgcattcgaagcgttcaaggaggcggccggcccggatctgcgcgcattcgccgcatggtcggtggcattccagatgtggggcgccccatgggagggcacatggttcgcggagacgaaccgtgattcgccggaagtggccgaactcatgcgcgatcatgccgacatggtcgaattcgaatgctggctgcagtggatcgccgacgaacaggtgaccgccgcgcagaccgccgcacgcgaaagcggcatggcattgggcctcatgcaagacatggccgtgggcgtgcactcgctgggcgccgacgtgtggtggaatccggaacgcttcgccgtcggcagcgtcaccgttggctgcccgccggacttctacaaccagcagggccaggactggggccagccgccgttcaatccgaactatctcgccaaaaccggttatggcgtgtaccgcgaaatggtgcacaacatgttctcgcacgcgggcgcggtgcgcatcgaccatgtgctcggcctgttccgcctgtggtggattccgcagggcgaaggcgcacgcggcggcgcatacgtcacctacgactatgaggcgatgatcgcgatcctcacgatcgaggcttcccgcgtgaacggcctagtggtcggcgaagacctcggcaccgtgccggattacgtgcgcaccgtgcttgccgagcacggtctgctcggctgcacggtggaatggttcgcccgtgtggacgactcccccaacgccggcgacccgtatgccgatccggccgattaccgcgagtatgcgttggcatccgtcaccacgcacgatctgccgccgaccgcaggctacctgcagttcgagcatgtcaagctgcgcgaagaactgaacctgctcaccggtccggtcgaggaattccaggcgtccgcaaccgcggaacgtcaggccatgcttgaccgactggtcgaaagcgaactgatcacgccggaaatcgccgcggacgtcgacgaccatattcaagagatcgtcgaggcgatgcacaagatgctactccgctcgccatccgtgcttctgcaggcggcgctggtggacggcgtcggcgaaacccgttcgcagaaccagccgggcacgtccagcgaatactgcaactggcgcgtgccactggcaggccccgaccacaaggtggtgcacaccgacgaagtgttcgacctgccgcgcgtgaagtcgctttccgccatcatgaacggcgaaaagtaagcgtcctcatataactccataaagtcccgtcacgcaccatagacgggtgtccgtaaaacagttaatcctccgtatggcttagaccatgcggaggatttgtttatgtctaatcttcaaacttgctggcggcaaacggtttgtcaaaaccgtttgcggacggcaagtccacaggggatagccgctttagcggcgcaagggggtgtagccaccttgacggaacgaagtgacgaaacattctcggtcgtgcagttttcttctgctgaccgggaatgaagctccgcaggacgcactactctcgatagagagtatagaagtgcgccctttagttcctaaagggtttttatcagttcgacaaacttgaattcaattttaatgttttattagtctttacaaatcacctttgaaccttcatcattgactataattgcctggtggttgttaatagcacagatattcaaatccgaaaactcagccatgattctctcggtaattttcttaaagggtgccgtgagataatggggaagaacatagaaatcaatcaaatccagccccctcattatcttcttgagagtaatcctctggcttttcatccatttgttcaatatattgaatggtcggagcgcatataattgcgcctgccgactcaccgatcatcagttttccgtttgccaattctttcttcaacagctcgtccgtttccgttttacgtagctggtccataaggaagaaagaatttccgccggtaaaatatatcacatccgcatcttcaaaaacagcctgtatcgttgaataaacctccgttgagatatcaatttcagttacagatgctcccagttttttgaatagttttcgagccgaaccaacataaccggtgtaaccttcatgcagcgaagctgttggaataaatgcgactttcttgttatcaatttcttcttttatcaaacttcctacgcttgaaaagtgcgaacataaaaacagtttcatctaaattttcctttatgacttctgatttattgctcaatttcgtgttcaaattataccataaaacttgtgaacaattctaccgcaactttggaatatatgagaaaagtccgaacagttttctgcccggactttctcgctcaatcataaatcaattccgctttcacaacttcctctgcctgtgccttgcaagcgttcatctgccgtacccattccatttggttttcagctttcagctgttcggccacgtcgtactgctttgccagctctggcatgatcagctccatgcggtttcgtgccgcttcgtcaatcttagcgcaatactgtcttatgtacacccgtctatatgtgacgggacttttttatgcacattcaatgacaacgatactaagaaagctacgcaaggaacagcagaccgctactcgatgtacgcatgcaaacgattgccgcaccgccgagtagactggtacgcatgaagttcctatcacccgactccggctttatgcgcggcctcagcgacgccgtcgacgcgatttggatcaacatcctcatgttggtcaccagcattccgatcgtcaccatcggcgcggccttgaccgccggtcacgatgcggcacgacgctcgctcgcaggcgaaggcaccgtcacccgcaattatttcgccgcattccggtcaaacttcgtaaaggcaaccggctattggctgattttcggcattgcaggggcgatcagcgtgtactcatggatcgtgctgcagatcacgccgctgctgattccgaaattcgcgttgagcatcgtatgggtcatcggattcgaatggatatgggcattgcagtcacgcttcgaaaactcgttctggcgcacgctcggcaacgccttcgtattcggcgtgagcaatatcgggcacacgctcggcatggccgccatcgacgcggtctatatcgcactgctggtcggcagctggttttacatgccgcaaggcctgttcctgctactcgttttgggctacggcaccatgattatgattcatgtgccgattttcgagcacgtgttccgcaaatatatgaagtagttttctgattcggatatgaaagagtccgagcgagatttctctcgttcggactcttttttgcgaggcggcggcgttttcccgtggctgatcgaaggatcatccttgacggctccgcaattaaggatcggtcttcggccgggctcaatgctacctgagcgaggcctgtcggcctcgctcaggctggtgcatgggacagcgcactgcactgtcccacaagggatgatcttcgatcatcccttgactgcaccagccattacacccttgacgatgtgcttctggcagatgaggtagaagacaataatcgggatgatggccatcaccaggcaggccatcatagcgcccatatcgacggaaccatagccgcccttaaggtactgaatagccacggaaatcgtcttgtacttgcccaaatcgagcgtcaggtacggcagcaggtagtcgttccaaatccacattgcctgcagaatcgcaacagacacgatcgacggcttcatgatcggcaccacgatctggaagaaaatgcggggcacggaagcgccgtcaatcattgcggactcttccaacgactgcggaatgcccttgaccacaccggtgaagatgaacacggccaggcctgcgccgaatcccaagtacacaatgcacaagccccacggagtgttgagcttcagcatatcggcgagcttcgaaagcgtgaacatcaccatctggaacggcacgatcatgttgaacaggaacagcgtgtacagcagcttcgcagcccagttgttcacacgcacgatccaccatgcgcacatcgaagtgcacaccaggatcagaatcaccgagccgaccgtgatcagcagggtccagccgaagctggcgaagaaattcgtggtttcaatgccacgggtatagttttccaatccaacgaacgccttgccggccgggatggagaacgcgttacgcgaaatgtacgccttctgcttgaaggagttgatgatcaccaacacgatcgggaaaatccatgccagcgataccaaggaaaacagtacggtccacaatccgccgtgcttgaccttttctccggaaatcatgcttccacctccttggaagtcgtcagcttattctgaatcagcgcaacaatcgcgacaagcacgaagaacagcactgccttggcctgtccaacgccttcccagccgacgcggccatagaaggtgcgggtgatgttcatcgccaggccttcagacatgttcgacggagcgccgttcgttaatgcgaggttctggtcatagagcttgaagccgttggtcacgcacaggaacgagcacacggtgatcgacggcatcatcagcggaatgatgatcttgaacatggtctgcgtgccatttgcgccatccacggaagccgcttcgagcacgtcggtcggcagcgactgcatgccggcgatgtagatgatcatcatgtagccgatctgctgccagcacaccagcacgaccagaccccagaagccgtacgttgcgctataggtcagcgagcgcgcccagtgcgcgagaatgccgttgagcagcagcatccagatgtagcccagaatgatgccaccaatcaggttcggcatgaagaacaccgaacggaaaatgttcgatcccttgatcgccttggtgagcatgtaggcgatggagaacgcgaccacgttgatcacaatcgtggtaacgatagtcagcaacgtagagaagcccagcgcatgtaggaattccttgtcctgcagtgcgcgggtgtagttcttaagccctacgaactcggcgtcggtaaccgtagtgaacttgcaaaagctcaggtagacgcccatgatgaatggaacgacgaatccaataatgaatgcggcgaacgttggcagcgcaaacagcgcccaccatttccgtatcgccttgccagccatgctgatcatagcctgcctgctttctttccttctccattccgatcaccgcggcaccgcggtgcggaattcctgcaattgttggccgaatcagcggatcactgctctgttctccacctttccggtatttacactcgtcatgataaacggcatgacacgaaatgtcaaacgttgtcatttttacatgtcttgagacgcaaatttaccaacgttgccatgtttttgattataaaaactcgttgcaatatcaagcattttaagcctcttctgctataatgaaaacgtttgtaatgcacgtattgcaaagatgtcgcaatacagtatgttggaacgtaagcagtcacaaggaaaaacatgaaaagcagtattcaagatgtagcgcagcttgcgcacgtatccatttcaacggtttcgcgttccttcacacgcccggatctcgtgtcgaaagccacccgagacaaggtgatgaaagccgcggacgagctgaacttctccatttcacgttccgcagccgcgttgaaaaccggtcgcgcgctacgcatcgcggtcctggtttccggacggctcaacctgtggttcagctcatccatcatcgaaggcctcaaccagatcttccacgacgagggatacgacatttccatctaccagatgtcgagcatcgaggaacgtcgtgaattcttcgacatgctgccggtgcgccgcaacgtcgacgcggtaatcgtcatttccttcgatatcgacgccaacgagatcgagcagttcaagtccgtcaatgtgccgatcatcggcatcagctcgagtctgccggaagagcgaggtttcaacgccgccgtgcgcatcgacgacaagcagggatccgagcttgccgcacgccatcttatgacgctcggccaccgtgacatcgcctacattcgcaccaaccgcgaagtgacgctccacttcagcgtgcagggacgtttcgaatcgttcatggcgtgctgccaagccaacggcgtcgaaccgcgcgtgctcgtcaccgacgaaagcaagaacaacatcagcaaagtcgtgacgcagctgctcagcctcgaccatatgccgaccgcgatcgcctgccaggaagacggcatcgcggtgccgctgctgttccagctggaacgcaacggattcaccgtgccgaacgatatttccatcatcggctacgacgacagcatttacgcgcgcgacctcggcctgaccaccgtgcgccagacgcctgtcgaaatggcgcaggaggcggcccgcatgacgctcgatctcattgaggagcgcccgcttgacgaaccgttcaaaacgttcccggcgcagctgatcgtgcgttccactacggctcgcctgcatcgctaaacgatccgaacgagcaccgttcgcatagcgtctgttttttgctgccatgttgaatttcaccacttcgtgacagcgtttacaggctaccgttgccttacgctatcttgtaatcgaatctttatattcgtctttcgactactgtaaatgatagcgcttacatttctgttgtacaaattcaccaatctacagcgtgttttcgtctaaaatcagggcttttagtatcatggaagcgttaatcattttcatcaaaggagacacatggccaaaccgaccatcgccaacgtagccgaattggcaggagtgtcgcaagccaccgtttcccgagcacttcgtggcgcgaccaacgtcacagaagagacccgcatcaaagttcagcgggcagcggatcaactcaacttcacactctcaaaaagcgcttccgccctagcatccggaaaaaccatgcgcgtcatcctcctggtctcgggcaaactcaacgagtggttcaattccggagtgctccaaggggtctacgaggagctcgcgccggtcggctatgacgtcacaccggccttcatcaccgaccgcagcgaactggaccggttcttctcccagctgccgaaaagccgcaacgcggacgccatcatcatttcctcatttcagctcatgcccgccatgcgcgaccagctccaagccatagacctgccgaccgtgggcgtcaacgttcctgcggaatcgggttatttcgacgcttccatcagcatcgacaactccagtgcgatgaccatggccgtacgattgctgcgctctctggggcataccaacatcgcgttctgcagcgactacattccggccgacatggtctacaacaccagccaacgcacccaggcgttcgcggatgccgcacaggccaacgccaccgatggaatcacattcagcctgcttacggccgacgcgcacgatgcgccgctgagcaaatccgacctcgcctcgcaactgaccgcgaaactgctgtcacttccggaacgccccaccgccgtctgcgtggaaaccgaccaagtcgccatcgcactggtcaaggaactacgcaagcagcagctgaatgtgccggaagacatttcagtgctcggctttgacgacgctgaaatcgcacaggcagcggatctttccaccattcgccaggagccaatcgaactagggcgcatagccggtagaaaagtgctgcagctcctacgtaacgaacctcttgaacatccgcatgaactgcaggatcctttgctggtgttgcgcaacaccacaagccgcattgacagcggggcggcgccggcagaataaatcggcgtcataaatcgacggcagctgaataaatcgagaggcagcggaaaaacgtaaagccgccaaaacgcgaaagcggcctgtatgcatgaaccagatcatgcacacaggccgctcttttcatcgcaagccttgcagggcttcaatcagcggtgcgatctcacccctgctgatcgaatttctgcgcttgaggaacggatcccaacgattcctcgttgttgttccattcggtggcccagccgtcgacgtaggcgctcttcaccttgctccaatcgccggtgccctgcgcgtattcgataagcgccgcggcgacgtcgtcctgccactgctgatccggaacggtaaagctgcgtacctcggtcttgccgtcggcagcgtaggagcgagcgatcttggtcagcggattatccggctggaactcatcgccatcgaatgtggtgaacggtacggagaagcccatatcctgggagaggatcttcttggcctcgtcatcggtgaccatccacttgatgaagtcgagcgtggcctgcttgtctttgtcggaagcgttcttgttcaccgcccagctggcgtcatacacgcctgcgggaccgctctcctcctcgcccttgatgcccatgtaatacggcagcatgccaagatcgtcgtccgctacttcgttacccttgatctgcgtgtaggcccagacaccgttcggatagaacgccacctggccgagcgcgaattcggaagtgacatcgtcgtacgtcttcgagttgaccaggctcggatcagtcgggctggtctccagctcgagatcgaacagatccttgtagttatccaagtaggtgcccttgatggtcttggagaacgtggtgttcatgtccttgtactcgtagtacagcgggatgcgccccatatgcgcggagaaacggtatgtgtcggaggcatccagacctggcgtcgcgaacgcgccgtcgacgccgagatcgtccttgtgctcgttgatggactcggccacggccttgagcgtcttgtaatccttgatgtcgtcggcgctcttgatcaccgcgtaatccttgctggcgtaatcgttgatgatcttcttgttgtagatgatgccgtaccattcagccgcgtatggcagcgtgaacgaatcgccatcaatggtgtaggagtaggccttgccgtcatcggtgagcagtttgtacgcttcggtgtcctgcaatggctcgcaatacttctgatattttgcgaactggtcgaaaccggagatgttgaacatggtcggcgcgttggacttggccagctccgagctcatggtcgcatcgtatgtgccggacgcaccggtctgcacgtccacctgcacaccggttttttcggtatacatttcggcgagctgcttgtattggtccacgacttccgacttgttgttcatgaaatacacatggcccttgtcggaatcagcgctgctgccgccgcaagccgccaacgatacgcccatggccaacgccgcggcgaccgcgcacgttttggtgatgattccctgcttcattgcttatctccttcgttggatttgttgttattcgttggacttgctgattttcgtggtagatatttgtacgtgcgccgacattgcttccggccgccgcgttatagctggagccagacggtggtgtcctgcggcaatcggccatcctcggtgagttcacccgacgcgaggatgacatcgccttgcggtagttcggccggacgttcgccgaaattggtgacgctcgcccaaccgttggaacgactgtaggcgatgactccgccgcgttgtccatccgcgccgtcccgcacgtcagatggacgatcttcgtccagccactgcagttcggtgtcctgcggcatcaggttatgcctcaacgacagcgccttgcggtacaggttcagcatggaattcgggtcggcatcctccacgtcgacggcgaaatccttgtaccatttcggctgtggtagatgtggatcatgctcggcgcccgcaggagagaaaccgaaagaaccatcgtggccgaattcgtcatcgggatcatcgagcttcggtgcgtctgcggcgacccagggcagcggcacacggcagccgtcacggcctttttcgatttgctcgcgcacgctgttgaatgcggtgggatcttccagctcatcccaaggaatatccgcgacttccggcagtcccagttcctcaccctggtagatgtaggtggatccaggcaaggcaagttccataagaatcgcggcacgggcacgcttggcgcccaattcgcggttctcctcataggtggtaccgtcgcgcagcagccaatccttggccagctgatgatgcgacgaggctggaacctgcggcaatccataacggctggcgtgacgaggcacgtcgtggttgctcatcacccaagtcgcggaggagccggaacgttccgcgctttccaagccttcctcgatggccaggtgcatgtcgtcgcgaatccagtccttcttggcgaactcgaagttgaacacctgtccgagctcttcggtcgacgcatacagatgctggcgatccggattgacccaggcttcggccacggcgaatgccggcggattgtactcgttgaacaccttgcgccactcgcggtagatgtcatgcacctcatcacggtcatacaacgggtgcgacccgtccgagggaagcacatgctcgcagaccttgtagctttcgaggtcgtcgcggtcaagatccttggcgaggccgtgcgccacgtccacgcggaagccgtccgcaccatggtcgagccagaagcgcagcgtcttgatgaagtcggcgcgcacctcggggttcttccagttccagtccggctgctccttggtgaacatgtgcagataccactggccgtcaggaacgcgcgtccacgccggaccgccgaagcttgcgatccaatcagtcggcggctggtcgccgttcgggcccttgccgtcgcggaagatgtaacggtcgcgttccggggagcctggggcggccgcgagggcggccttgaaccattcgtgcaggttggagctgtggttcggcacgatgtcgaccacgaccttgatgccgtgctcgtgggcggccttggcgagctcgtcgaaatcgtccatggtgccgagcttcgggtcgacgttgcggtagtcgtccacgtcgtagccgccgtcggcaagctgggacgggtagaacgggctcagccagatggcatccacgccgagttcggcgaggtagtcgatcttctcggtgacgcctgcgatgctgcccaggcccgaaccgcgggagtccttgaaggaacgcgggtacacctggtagaccacggcctgcttccaccacaacgccggatcgctaatatcaatttcttgttgcaccatatgttttcactttcgttcgcatcgttgcaaaatgatagcggttacatttcttcaaactacagataagaacatttttaaatcaacatcttttctgcttgttattaacaatgatagcgctttcattactgcaacgcaatccctccgacgcacggcgtgtcctacaaccgtacgtcgccgcataaaaaaacgaactgcaatcaggagaggaaaggaagacttccgattgcagctcgttgcttgttcaattattcagttatgcagttattcgatcaatcacgcgccgatggtatttccaacggtccgcgctacgcgacgcgcggaccgattcgtcatgcgcgattacgattggtttttcgagacgatcagtgagacgcgtcgtattcggtcttccagccgtccacgaatgcggtcttgacggcaccccagtcgccggtgccctgcgcgtactcgaggagggcggaaccgagctggttcttccactcttcggacggcatcatggtgaagttccaagagactgcgatcttgtcagaattctgatcttcaacagcggcctgcaccagcggattgtcggacttgacatcgctgaaggacttgaacggagtggtgaagcccatggcgctagacagggactcgatgccggtcttgctggtgacgacccacttcaggaagtccttggtggcctgcttatcggcgtcggaagccttggagttaatgcaccagtagttctcggagccagtggccagaccctggttctcctcgcccttgacgcccgtgtagatcgggagcatgccgatggactcggccttcatgccgttcttctgcagatcggtccatgcccaagtgccgttctgatagaacacggcctcgccgagggagaactcggaggtggcgtcatcaccggtcttggagctcagctgggtcggttcggtggtggaatccttcaggtacaggtcgaagatgttcttatactccggcagataggtacccttgacggtcgccggctgcttggtgatgttgtcatccttgaactcgtagtacagcggcaggttggccagatgggtcttgaagcgccaatcggagctggaatcgaaaccggcggaagtgaatgcgcccttaacgccgagctggtccttcttggcctggatgtcatcagccacggctttcagggtatcgaaattgtcgatatccttgacgtccttgatcttggcgccatcggtggcgatgtacttggccagcagatccttgttgtaaatcagaccataggtttccatagcgtacggaacgccaacgaccttgctcccatccttgagggcgacgtccttgttgatgagctgcttgtacggctcggtgtccgtcatgtcatcagtgtaggacttccagttctgatagccgaccggaccattgacctggaacagggtcggggcttcggacttggcgatctcggacttcagggtctgctcgtaggtgccggaagcagcagtctggaccttgacctcgacaccggtttccttggtgtaatccttggccagcttctgccattcgtcgttggattccggcttgaagttcaggtaatagaccttgcccttgccgtcgtcggagctggagttcgatccgcaagcgcccaacgtgcctacggacatcgccgcgatggcgaccattccaactgctgccttgatagtacgattcatcatcgaacctttctcttccattcctgtttcccagcaccccgctggtcaacatcctgtgaaatcgcttcctcacgattcctgacatgcactattgtgccgcatttctcccatttttgcaaacgtaagcaagaaaaaccatttttagagtgattttacgatcgcaggtttttctcaaaatactttattttcaacggttttcatcacactgtctttatgaaaccgtttgcgacacaccctctatatcacacggcaacaatcgcagtgactcgcgaacctgacgccgtacggcaacaaaaaaacgtcggcggtttgtaaacgatgtcaaactaccgacgttcagcccagcgcaacgcacctagcaattccaatgctcgataacgttgtctcccttatattggctcagcacgcaataatgcgcggtgtcgaggcgcagcaaacgcgcgaaatgcggatcgacgtccagccactgcgaggtgaggatgcgcaacacatgcgcgtgcgccaccaacagcacgtcatgaccggcattgagcagcggcatcaccgcgtcgatcgcatcgcgggtgcgcgcggcggcctcctcaaccgtctcgccagggccattgtgcaccggaacctgctcgccgcttggcaacgtctcaacccagtcgccctccaacgattcaggaagggaacgcggaccgtcgcgccatacatcccactggaagcctccagcctcgctcacctcctggcgtgtacgcccttcggcacggccgtaatcccattccgcaatctcgtcaagcactttgaaatcgccataaccagccagttgcgcggtctgctgggcgcgacgcagggggcttgcgaacatgcagccttggtcgaaaccattggggaacgcctcacgaagacgctcgcccgccgcacgagcctgctcgcaaccggtatcggtcaacggaatattggttcggccggtatgctggcccgattcgctccacacagtctggccatggcgcagcagtaccaggcggccgggcgcgattgaagaagcatccttgcttccgacttgagtatctgtcatactcctactctagccgacgaaaagcgtttcaccagcaatcttccaccacgtgtcttaagcgcttcgcaacgcacgcatgcgccggcgaaatccaaccgaaatccgacgacacggtctacactggaaatcatgagtgaaatgcctgacccggaatccagcgcagaccgcatcgtagcgtcgctgcataacgtcgacgagaaagtgaatgccctgcgcgaacagcgaatcaacgatcccgacgatctttgcgacaagatgttcaaggtggccgcccccacgctggccggactcgtgttcggcaaactgttcgaactggcatggcgcaagtcggtcggccgcaaagccgtgttgccggacggcaccaccgacaaacgcaaggaactggcgctgaatctcgtgttcggcgtggcttccgcaggactcggcgcgctggtatcgcaactatccgaccgcggatcgcaggcgctggtcgatcgccgccactcccgtcaatcgcgccgaatccgctgaaaccgtggaatccgctagatttgccgataagcgcaaatttcgccagatccgcaaacaatcccactccaacttccatatttcgaagcatgcgattcagatctgcaattgaagctgcggttggaaccgcacgaaactgcgattggaaggaatgcgcttgcgggcgaaaatacttgcgcaattacgcggatgggatataaatagtcaacatgagtaatattctgcataatgcaactgtcgacactctgctggagcgtcgttccatccgcaaattcaagccgaagccgctgagcgacgatatcgtcgaaactctcgaaaccgtggcccagcatgccgcaagcagccaattcctgaacgactggtcggcaatccgcatcaccgatccggccgcaaagaagcgtcttgccgaaatcggcgggcagccatatatcgcgaccgcgccactgctgtacgtgtttgtgcttgacgagcatcgcaatgcggccatcgcagcttccaagggcgttgagaccgcttccgacgagtttacgttgaatggcagctatcgttacactcaggcacagaatgacgcagttttggcgcttcatgcgatggagacggccgcttattcgctcggccttggctgtgtgattctcggctcgctgcttaacgatgttccggctttgattgatctgctgaatcttccggaatacacgtaccctgtgctcggacttgcgattggcaagcccgatcaggatcccgcactcaagccgcgtatgccgcgctccatgcagttctttgagaatgagtatccgtcgaacaatgagacgttgcttgccggtttgcaggattttgacgaggaagtgcatcggtattacgatttgcgcaataccgagcgcccagttgatccgttcagcgatcagatcgcgtcgaatgcggtcgattccggtgtgaccagcaaggccgtggctccaaacgccaagcgccaaggcttccgcctcgagcgctaacggaactacttacgacgtggtttgtagccttttttgcgggaatgcggtttaatctgctgattgaagggcacgtacgtgtagctggattgtggatcgcgatgtgtgagatgccaggttccgcagcattcgcaccgatacacccatagttcagtgccgcgttcacgcc

SEQ ID NO: 83 - DNA, 59213 bp, Bifidobacterium pseudocatenulatum
gcggcgagcagcacgcttgggctcagcacgtcgaggttcgtgcccagccagtcgttcagggagccgaccagaccgtacttcgcgccgtacatgaagccccacaccaaagtcgataccacggccggcaccgcgtacggcaggaacgtggagatgcggaagaacttcgcgccgtgcagcttcatggaatccaacgccagggctatcgccgccgacaggaacagcatgattggcacctggacagcggtgaacagcgcgaccctgccgaccgagctccagaactgctggtcgtggaacagacgaatgtagttgctgattcccacgaacttcgtgccgccgatcatctgcttctggaagaagctgatgtagatcgcgtacaggatcgggatcacgaacacgaacacgaacaccaacgcgaacggccacatgaacttccaaccacgccaatccgcacggtgacggttgacgcgaatctggtccgcaggcgtatgcagcgcatccgccgcgactgctgcttgctgagacatgctttcttctttctgtatgctttttgctctattgatcgcacaaccatgtgcaatggttaatccgcaaaatcttttattgtttgaattacaggattgctatttttttgaaatctttttctattgtaagatttcgtttttaaaattatttttgcgaagtgaggcaggcgggtcacgtcagacgattcccacctgccgtcgatcttcatggttgcgatggtgcgttgcgtatgtcggatcgcattatcgcgtttttcgttgtgccgcacggcagcggctgggcgccgtcagtccttgctggtgacggtgtagccctgctggttgccgtgatcggtgagcgccttgctgtagttgacgaaggcttcctccagagtgatgtcctcgctgtaggccttggagatctgatcgccgaaggtggactgcgcgtacgggttgtacggcaggtactggaaggcggagaccttgcgctgggcggcttcggagagaatctcgttcacgttctggccgccgaagtagtcgttgaccttcttgttggcttcagtgttcggatcggtgaaggagtcggaggagaggatcttcttcaggctcgggaaggtgccggtgtcggccatggtctgggcgccgtcgccgtgggtcaagtattcgacgaacttgtaggccgcggcctgctgcttggactgggagacgaccgcgagtgcggagccgccgtcttcagcggagacctcgtcaccttcgttccactgcgggagctgggccacgcgccagttgccggcctggtcaggagcgccgttcatgaggttaaccggcatccatgcgccgatggtgagagtggcgatgtcgccttcgttgagcgcacggttccagtcgtcggaccagttggcgatcttggtgtcgacgaggtcttcgtcgatgagcttctgctggaattcgatgtacttcttcatgccggaatccttggtcatgtcaatggtgatgttctcgccatcaaccttccacggctgcgcaccggcctgccatgcctgggcggtgaagggctggtattccatggaggagccggaattgttggtcatgtaggcgccgatggccttgaccttcttggctgcctcgtaataatcgtcccaagtcttgatctgggagccgtcgacgccggccttcttgagcacggcatcgttgtagaagaagacttccgggccggaatcaatcggcagcgcatacggcttgccatcatactgtagcttgctccacgggcctgcggagaagtcgtcttcgagcttgtcggcaccgtaggcggtgaggtcaacgaggtcgccggtaaccgcgaactgggtgacggtcgggtcttccagcatgaccacgtcgggggcacccttgcctgccgcgacggcgttgctcagtgcggtctgggtgtcggatgcggtgccggtgttgttgaatttgacggtgattccgggattggccttttcgaagtcggcgatcagggccttcatggtgttgccggtgtcccagccccagaaaacgagatccgccttgtctgcgtctccggcgttggccttggcgtcgttgccgccgtcgctgccaccgcaggccgcgaggctggcgagggttgccactgctgctaccgctgcgagagccttcttcatgttgcgcatgttcttttccctttctgccatccgcttcgcatgctgattgcatgtcggtcgcatatgtttcggaacatccgccgcggaatgcacatgccgcgctttccacttggtgatgtttgtatgttcgcgacctgccaaacaatacccccgtggtgatgtttggactggtaggatggctttgtttcctttctgatacaaccgtgtaccattagctccgatgatacacggttgtatcaaggtgtcaagcaaaccggttcgatagcccccctgcaactgttgtgcgctattgaagcgccaacgaaatcatcggcgtttcgcacaaacagaatgacatcgtttgcacaataatctgcgattgtccgcgcatctcaaccaaaaaatggatcgcaagaaagctacctcacaagagaaaacatataaagaacatatacaaaggaggtctgcgaatcgcaagcctcccaaaacaacgcatacgacgaagagacggactccgcaccgctcgatgagcctacaaactgaggaacagctcgtgaatgcgggtatcgtcggtcagttcggggtggaacgccgtagcgagaatcttgccctgacgcaaaccgaccacattgccgtcgaccgacgtttcgaccgtggcccgctcgccgacctcggcaacgaacggtccgcgaatgaacaccagagggaaatccttgagcaccaccgacgtatccgaagcctcggaagccccctcctcaccagcagccgcggaaatcgcagaagagacagactcccctgacgcaaccaccacagcatccgcatcgtcggaagcgccgaaatcggcggacgcagcgaacgaaccaagctgacgtccatacgcattgcggcgcacgaccgcatccaacgcgccaaaatagacgttctcgtcgttatcgagacgacgagcgagcaaaatcatgcccgcgcaggtgccgaataccggctttccagcggcgatatgcgcggcgatcggctcgaacaagccggtcgaacgcagcaatttgccttgcgtggtgctttcgccgccaggcagaatcacgcgatcgatcgaatcgtcgaaatcctcggcggcacgcagcagtttccacggcgcaccaagccgatccagcatcgccgcatgctcggcgaacgcgccttgcaccgcaaggatgccggtcacgccatgctgcgcggaagccgcaccttcggcaacgtcagtcgattcttccttcgaaatgtattcaacggcaacaaccatcggatctccttacccgaaccatcgcgaatcatgcgaaacgggctgcgcgcggcgcatcgaacagacatgccgacagccgcacgcagcgcacagcgcacgaaattacagcgcaatcactcgccgcgagcggccatgatggtttcgatctcgtcttcgttgatgccgaccatggcctcgccgaggttctcggaaaggcgtgcgagcaggtcggcgtcctgccaattggcggtggcctgcacgatggcggcggcacgcttggccgggtctccggacttgaagatgccggaaccgacgaacacaccttcggcacccagttccatcatgagcgcggcatcggccggagtggccacgccaccggcggcgaagttgacgaccggcagacgaccgttgtcgtgcacatacttggcgagatcgtacggcacggccagctgcttggcggcctcatacacctcgtcgtcgcgcagggagacgagctcgcggatctgcttgttcatggtgcgcatgtggcgcacggcctggatcacgtcgccggtgcccggctcgcccttggtgcggatcatggaagcgccctcggcgatacggcgcagcgcctcgcccaggttcttcgcgccgcacacgaacggcacgtcgaactggttcttgtcgatgtggtacacgtcgtcggcgggactcagcacttcggattcgtcgatgtagtcgatttcgatggcctgcagaatgcgggcttcggcaacatggccgatacgaacctttgccatgaccggaatggacacggcttcctgaatgcccttgatcatggccggatcgctcatgcgggaaacgccgccggcagcacgaatatcggccggaatacgctcgagagccatcaccgcgcatgcgcccgcgtcctgtgcgatcttcgcctgctccggggtggtgacgtccatgatcacgccacccttgagcatctgcgccagattcttgttcagttcgttcctgttgttggccatcgccagcctttcgtcgaatcgtattccaccctgctgcagagcggatatctcttgacacagatactaacgatttttcgttacaaaatcatgtgaactgaatatttgcacgtcttaaaaagttgcttttcttaaattctgactatcattttcatgattgtttcattttcttacgatttcgattctgccgacgattccgcaatttcattcgcttttcttgcctgatatgcgccattcgctttcgattcgcgcgcacggctcctttcgaccgcactttcgatgcacgctataagaaatacgaatgacgcatgattttcatacgaccacattgcggacgggggtgcagatggattcgcgtattgcgcactacatacgcagtatgcgatcagcgatgcgcatggtggaatcgcggtgcgacaccagcacgacggcgctcccccgctcggcaagatcattgatcgacccgagaatcaccgactcgttataggcgtcaagacggctcgtcggctcgtcgaacagcaccaaatcggcgtcgcgaaggaacatgcgggccaatccgatgcgttgcttctcaccctccgaaaggcggccacccagctcgccgacccgcgtatccaagccgttcggcagcgcatcgaccagttcgagcgcggacgccttggcgagggcttcgcgcaatacggaatcgggaatgtcgtgcgcgagatccgaatcggaggaatcagcggaattaccaccagcattactgctggaattactacagaaattactgccagaattactgtcagaatccgaaaaatcggcgtcattgcaggcaatagcgagattttcgcgaatcgttccgtcgaacagatacgtctcctgccccatcatcgtctgcacgcgccgacgccatccggcgtcaacctgcggcaatggaacatccgacagcgaaatcgtgccggaatccggatcccagtagcgcatcagcagtttcaacatcgttgattttccacgcccggacgggccttgaataccgagaatgccctgccgtgaaacatcgagtgaaacatggtcgagcaccggttgcgaggcgatgccggcaccttgttcgccggaggattgcgcttccgcggggcgtgccggactcatgccagtcgcatgctccgaccgcccgtttggcgtgcgttcgacggaaatacgggcgccggatccatagccgaatgtgacatcgcgcattgtcatgccctgatattccgggcgttcgctcccctgctcgaccacagcgggagcctcatccatcaacgcgaacaggcggcgtgccgaagcaaacgtttgcgtcagattcgccggcaacgcactcaacgcaagcgtcggcccaaacgagctggcgagcagcacgaaagccgcaaccaacgctggggcgttcgatcccacggaacccatccacatcaggccttccgacatatcggcggcagtggaaaccgcagtgcacaacgtcatcgcaaggaaagccgcaatcgccgtgaacagcatcaccaataccgcgccaaatcctgcaaaatcgccatttttcacgctcagacgcacacgtttgacccacagcgagcgcgtgcgacgctgaatggacgcaagccgggcatcgccttggccgaagcggatgatttcgccgatgccacgcatatcgtcaagcatttcgtcatcgagggcggacgactccttgcgcagttccggaccgatgccgcgcaccgcggatgcaaaaagtttcggcagtatgacgccgataatgaggtgcgcgatgatgagcgtcgccgcgaggggcggactgagggtgagtagcgcgagcgcgtagacgacggtagtcacgatggcgatgacgaccgggctgatggtgtgtgcgaagaagatttccagcagttccacgtcggtggtgaccagtgcgatcaggtcgcctttgcctttgcctgcaagcttggcgggggcgagacggcgcagggccgcgaaggctttcgcacggaataacgcaagcagacggaacgccacgttatggttcatgaactgttcggcgtaacgcatgccgccgcggatcagcgcgcatacggccatggctgcgagcgccgcgggaacgctgaggttccagaccggcgagccgactgcagcgaaggccgccgcgatgccgaacaccggcaggaaagtggcggcgagatggccgagcgtgccgcagacgcacgcgacgatcatgtacttgcgctgcggcccaacctccttcaacaggcgcgcaataaggcgagacgtgggtattgtcttcgcgtccgattctgccgaatcggacatccgaacgcccgttttcgcaccctgtgcgtccgtttctgcagaatcggacattcgagacgtagtttcggcacgctgcgtgaccgattcgggagaatcggacaactgagcggtgtttttagtgagttggttgtccgtttctgcagaatcggacacttggagacccatttccgcacgctgcgtgactgattctgcagaatcggacgctttaagtgcgtgggatgcagaggtggaatgggttgcgttattgcgtagacctatgttttccacggtttgttgggcgtggaacagtttggcgtatgttccgttggcacgcatgagttccgcatgcgtgccttgttccgccacgcgcccgtgttcgaataccaccacatggtcggcgtcggctgcattcgccatgcggtgcgtcaccatgatcacggttttgccccgattggcaagcgcatgaatggtttgcagaatcagggtttcgctttccacatcgacgctgctggtggcttcgtcgaaaatgtagacggcaggctcccgcagcaatgcgcgcgcaatggcgatgcgctgtttttggccgccagacaggttgcttgcgccctgttcgatggccaggtcaagttcttgcgattgcgcacgcacgaaatcgctgatatgcgccgcttccagcgcttgccacagttcgctttcggtggtatccggcttggccatcagcagattgtcacgcaacgttcctgcaaaaaggtggctttgcgccgccactatggcgatttccctcgtaagggattcgatggaaagatcgttgatttggtaccgttgcgtcgagttgtttcctgtgtttccggattgcagccacatacatccttcatatccggaaagatttccggagagcagttcgacggcggtggatttgccggatccggagggaccgacgatggcggtcacctgcccgcgccgcgcagtgaaagagacgccatgcaatgcgacgaccgaaccatcatcatctttcgacgtgcctgtttttccagcaccaaccacaccggactttcccccgatttgtccagtttttccagtttccatatccgccgtcacagccgtatccgcagccacactcacagccgccgcagcgtccgtattcacgtccacatatcggaacgacacgtcatcaaagcacacgtccacaccgttatcggaagcgccgaattccggcatttcctgcatcccatgcgcaggaatcggcgtatcaagcaatgcgaaaatacgcttggtcgaagtcatgccgttcatcgcaacatggaagaacgaccccaattggcgcagcggaatgaagaaatccgcggaaagaagcactatcagcagcacgccggcaagcggcaatgcggcaccactcgcatactgccagatcgatacgcccacgccggccgcggcacccccgtatgcgacgacgtccatggcggtgagcgagcgcagctgaatttgcagaacattcatggtcattacgcggaattgttccgcttgctcgcccattttcttggcggcatgcgcatccgcgtcaaaagttttcagcgtttcaagaccttgtacattgtcaagaaacacagatcccatgtcggtgtattttccccaatattttttgaatactcgggctgcgcgcattgcgaccatgccaacaatcaatacaatcaaaggcgcgcatacaagcaatgtaacagccgtcggcatattaatcggcgcaactataaaaaataacgttaccggtgcgagaatcgcataaaacagttgcggtaggaataattcgaagaagctttggatttgttcgatgccttcaccggcagattgcaccacgtcggcagtgctgatatgttgcgaatatgatggtccgatcgcaagcattttattaaaaagctgttcacgtaacgcgagtttgacacgctcagccgcttccgcgccgaaataggccgctgcgcgcatcatcagaaaacgcagtaccgcacagaccacgatcgccagcacgcatccgacgtatgtttccgcactgaatccgccgtagccaaagccgatgaacaggcgggaaatcaggccactatcacccatggagaacatggggtcgaacgccgattccaccacggcaagcgccggcgaaagcatgaccaccaccgtcaccacgaacacgacgttggccagcagtccgacccattggcagagcactttcgccgcaaccaaccgtcccacgccgggagcgagggaaaacagcctcttgtcaaacataaacaccttccgtccaatgagcgcactcgcgttgccagctcgcctacggcccaaagcgcaatcgccatgcatccaacaaacgaatcgcaacaggccgatacgggaaaaccggtgcgtggcaaaccgttttcagcctatccaaggcagctcgcaatcgtcaagggcgcattgcatacagcgaaccgtcgcaatcgaattgccataatcgacctcaaatcagcaacgttgaaaagagaaaggctggatgttcgccgttgagcaggcagccctctgacgcaaggggtaaattgcgtcactcgtgagtgtactcgataaaaaacgctcgcaccaccatttcttcgcatttcgctggttttacggtcctttcggggatatatgggaagcatggcggctcccccgcaaccgttacgtcaagccttttttcgaacggatacagcgcgacaccaaacacttgatttttgacggaatagcaccatttgtcagttcatacaaagttgatgaaatatttcttgtcgcttctcacaatgcagacttacggccccgtaacttagaatgtgcaaggtgcgcaaggggtaggaaacgcggacacacggtttgtatcgctcccgcacgcatcacaagcagaaatacgcggaaacaacgcaaaaccgcgagaaagagaacgcttcatgctcaccgagtacaccaccccgggcgaatccgttgaggtgcgcgacgacgaatccatctattccctgcttactggacgcatagcgcgcactggcgaagataccgtgatcgcggaacgcaaaaccgcccccggccaatggacgaaggtcactaccggcgaattccacaatgccgtgctcgccgctgcaaaaggcctcatcgcattcggcatcaacaagggcgatgccgtcaccatcttctccaccacccgctacgagtggggcgtgctcgacttcgcactggccgccatcggcgcggtgaacgtgccgatctacgacaccgattccgcggcgcaggccgagcgtatcctcaacgattcggatgtgaaactggccatcgccgacaatcgcgagcgcttcgaccgtctcgactccgtaatcgaccgctgcccgtctctcaagcacattctgatgctcgattccaacgccatgggcgcgttggaaggcttgggcgtcaccgtgtccgacgaggagctggaagcgcgcatcgattcggtgcatgcagacgatctggccaccatcgtgtacacgtccggttcgacgggagctccaaagggtgccgagctttcgcaccgcaatttcatatcgatcacgcgtgcgggcagtctggcgttgcatgagatcattctcgaagatcatccgcgactgcttctcttcctgccgctcgcccactgtttcgcacggttcatccagtacgcgtcaatcgcttccgacgacggcgtggtcggctatctgccggacacaaagacgttgctgcccgatttgcgttccttcgaaccgacctatctgctgggcgtaccacgagtgttcgagaaggtgtataacgcggcctcccgcaaggccggcacgggttggaagggacgcctgttcctcaaggctgccgaagccgcacgcgattggtcgcgcatgcagcaggccggcgaacgcccgaccgccaagcagatcgcgcagcatctttcgtatgaggcttccgtataccgtaccgtgcgtagcgctctcggcccgcgcatccgctacgtggcatgcggtggcgctcctctggacgtgtctctggcgcatttcttcaacggtatcggcctaccgatgattcagggttacggtatgacggaaaccgctgcgccgttcgccgcgacccgcgtcaccgacaatgtgatcggcactgtcggccaaccggctccgggatcgtctgtgcgcatttccgatgatggcgaacttcaggtgaagggcccgaacgtgttcaggggctaccacaacctgcctgagaagacggcggaagcgttcaccgaggatgggtggctgaaaacgggtgatttggcgtcgattgacgacgagggacgtattacgatcaccggccgtaagaaggacatcatcatcactgccggcggcaagaacgtttctccgattccgatggagcaggagattgtgaaatgtccgattgtggagcatgtggtagttgtcggcgacaatcgtccgttcatcggtgcgctgatcacgttggatccggaaggattggaggcttggctgccttccattggactgtctgccgatacgccgttggatcgcgtggctgcgaccgccgccgttcacgacgaaatccagaagtacgtcgacaaggcgaacgcgaccgtttcccgcgccgaatccgtacgtaagttcgtagtgctggatacccagttcacgcaggaaaacaagtgcctgaccccgtcgctgaaagtggtgcgtccggcagtgaaccgcgtgttcgcacaggtgatcgatcagcagctgtactccggcaagcgctgaatcgcataatacataaaagcgtggggtgcgagagaatacaaacgttctctcgcaccccacgcttttgttctgtccgtacaactttcaaggaatgcaaacgagcgccggtgatcggaagcgatccgacccgccggcgctcatatggcagagatcagtgatgaatccagaatggctaacgacaccccatcagccattgtcagtaaagcgacaatcagtgacggttccgtcagtgcataacgcgtgcggtaacggtgcggcagaaggcgaaggcgtacgagggtacgtcgagtcttctgccgtgccgttaacgctccgttatgtcagtgacggttgttgaggcggtggtacatttcggagatctcaaggtcgcgctcgaattctgcggccttggtgttcgcgtcgatggtcgcgagttcgacaccggcgatgcgggcgaagtcttcccaagcctcgcgaccgacggaggtggtcatgcaggtgtggtgggaggcgccggaacgcagccagcactcggcggaggtcttgaggtccggctgcggcttccacaggccacgggcgcacggcagctgcttgagttcgccgagcggctcgaccacgtcgaccaggttcatggtcaggcggaagcgttcgcgcacgtcagacatggacacgacgacggcgtccttcttcggggcgacggtgaagaccaggcgcaccggatcggccttgccaccgatgccgagcgggtggatttccagcttcggcttggcgatggtgccgacggacggggagacttcgagcatgtgggagcccatgatcatctcgttgcccggggtgaagttgtaggagtagtcttccatgagggaagcgccaccttcgaggccgtagcccatcactgcgccgatgcgcacgagcactgcggtcttccagtcgccttcggcggagaagccgaagccgtactcggacgggaagcgctgcgggccaacgcccggcagctgcgggagggcacccaagtcttcgaagttgtcaacgccggcggtgcagccattggcgcgcatcatgttgaccatggcggcttcttccttggccgcgatgaacagggaatcgtacttggcgtcgagcagagccggatcaacgtcgtacttaaccttgtagtcttcgatgatgctcttgacctgatcgtccttgacggcttcgtaggctgcgacgagctcgttgacggcccaagtgttgatggatgcgccgaacacgcgctcggcttcggtcttgtcgccttcggtgacggccacgttgcgcatgttgtcgccccaacgcatgaccttcatgttgttggaagcatcccagccggcgcaggcgcgtgcccaggtgccgatttcttcggcaacggccggatcggtgtagtggccgaccacgatcttgcggttgatgcccagacgggtcaggatgtaaccgaactcacggtcgccgtgtgcggcctggttcaggttcatgaagtccatgtcgatggtttcccacgggatttcgaagtggtgctgcgtgttgagctgcagcagcggcttggtgagcacttcgaggccgcggatccacatcttggccggggagaaggtgtggcaccaggtgatcacgccgatgacgttcgggttggcggaggcttcgaccatgaaggccttgacgccgtcggaggacttcagggtcggcttaagcaccaccttgaccggaatcttgccggttgcgttgagcgcgtcgacgatttcgccggactgctcggccacctgacgcagcgcttcttcgccgtacagatcctgggatccgacgccgaaccagacttccttgccttcaaacgggttttccattgccatgtgattgttcctttacttcgttgtttatggagtttttaattatttattgcgattgcgaactcgcgcttcgcgttgttctgttgcgtagcgcgagttcgtacgattgtgaaattatgtaggattacggaatcgtaggattgcagctcagtgctggccgtagacgttggtgtaacgatcgttcagcttcgcgatatcctcatccgaaatcggaatgatctcacccaactgcctcgccgcccacatcgtatgagcgacctcctccgtcatcgccgcggccttcaccgccgactccgcgtccttgccgatggtgaacggaccatggttctgcatcagcaccgcaggagacttcggatactccctgagcgtctcgaccacgccctcgccgatcgcctcggaaccgatcagacggaacggacccaccggaacaggaccgccgaactcgtcgcccatcatcgtcagaccgcacggaatgttctgccccgtcgccgcccacgccgtcgcatacgtcgaatgcgtatgcaccacgccgtacacgtccggcatatgacggtagatgtacgcatgcgacgcggtatcggaggaaggagcctccgaaccgtccaccacgttgccgtccagatcgcacaccaccatgctcgacggcgtcagatactcgtaacgcagtcccgacggcttgatcaccatcagatccgcggtatgcaagcgctgcgacacgttgccagccgtccacaccaccaggttccacttgatcagctgctcgtgcaaggtcgccacgacctcgcgcacctgcttgacctcggcacgaacctcaggaccataatcagccaaagtagccataatcatttcctttcaaattgaaataagtttttaaaatatttatttacttggtttccagcggaatgctttcgattgcaacatgctcaatcggcagtcccttacggaagcgatcgaagaattcctcgaatcccgcgacatcgccttcatccggattttccgtggtcgaagcggcatcggcgaacacacgagcgtcaaggaattcgtcgagcggctggtcggcgtgccacaggtagtcggcaagcacggccatgccccatgcgccgccttcggcagcggtggacattaccttgatcggcgtatcgaatgcggctgcgagaatcttctgggcgaccttcggggtggtgaagatgccaccgtggccgacgagggagtcaacggcaacgccttcgtccttggtcatcacatccatgccgatcttcaccggggagaatgcgctgaacagctgggcgcgcatgaagttgccgaggctcatgcgggcttccggaccgcgcgcgaacagcgggcggccttcgggcagtcctgcgaggaattcgccggagcggaacgggtagttgatgagtccgccgcagttggagtcaacgtcgtccgcgatggcggcgcggaacagcgtgccatacagggtgccggcgtcgaccggagtgccgattgcagctgcgaactgtccgaacagaccaacccatgcgttgaggtcggaggtgaagttgttggcgtggctcatgcctgcgagatcgcctgccggagtggtgacgaggtccacttccgggtgcaggcgttccagcttgcgttcgagtacaaccatggcgaagatggaggtgccggcggaaacgttgccggtgcgcacgcgtacggagttggtggccaccataccggtgccagcatcgccctccggcggagcgaatgtgattcccggctgcagcgtgcctgtcggatcgagcagcttggcgccctcttcggtcagcgtgcccgcaggagtgcctgcaaccagcggttccggcagcaggtcggcaagcttccacggctgggctgcgacttccggaatcgcattgaacttctcaatgaattcggtttcgtaggtgtgcgtggtagggtcgatcgggaacatgccggatgcgtcgccaacgccgagcaccttcttgccggtgagcttccagtgcacgtagccggcgagggtggtgaagaaatcgaccttgccgatgtgctcttcgttgttgagcacggcctggtacaggtgtgcgatggaccagcgttccggaatgttgtactggaacagttcggaaagcttctcgtgtgcttcggaagtgttggtgttctgccaggtgcggaacggcaccagcagttcgccatctttgccgaaggcgaggtagccgtgcatcatggcggagaagccgatgcgtcccacgcgggtgagcttttcgccgtaagcgttttcgacatcttcggcgagcgccgcgtatgcggtctgcagcccggtccagatttcttcctgcgaatagctccacaggccgtcttccaagtggctggcccagccgtagtcgccggctgcgatggtggtgtacgtgtcgtcgatgagcacggccttgattcgggtggagccgaattcgatgcccagactcgtcttgccagcgcggattttctcggcggtcagcgcgatgcgatcgtcaagtccctgctcttgcgccatagtttcaaactccttgcatccgagcgcctcacaaccacattgtcgacggaatgttagcgctcactgttaacgctcactattctaaacagaaagtggcgactatacaagttcgacgtgtcacgcaatcgtcaacgtactaccggcagatcgtcagccgattttcttgatataccggcattacgaaatccggcaatcgcagcacatgcggcaaaaagagatacgagaatcacaagaaatacaaaaatcgcaggaaatattcagcgacggctggcggtgcccaaagaagtgcggccgatcaccttcgcgggaatcaggccgacgccatgctgcgacgaggcgaacgaattctcatcgccctcccccagcaaaaacagcgtctcacgcatggcggcaacgccaagctgttcaaaatccgggcgaaccgtggccagcggcgggtacatgttgtccatggcgggcatgtcgtcgaaaccgaccaagctcacatcctgcggaatacgcatgccatgttcatgcagcgcacgagacacaccaaccgcctggctgtcgttcgcacacaccatgcacgtcggcagatttccgccggtacgaccgatgttttcgagaatatggttcatcttgccatacgcttcggtcgattcccaggtttcgcattgcacggtgacggaactcaccgcattggccgcgcacagcttattccacgccatcaaacgcgtggcggcgtcacgccattccttcggacctgcgaaataaagcacggaacgatgcccatgctcgaccaccaaatgcatcacgtcggccatggccgaccattggtccactcccactacggatactcggcgacggtcggccggtttcatcaagcgcaaaccatcctgcacgctgatgctgccgtgcgtggaggtgacgatgacgcgcggctgcgtgatctgcgcacggcaggcggcggaaaacataacatccgtcggcgtgaggaaaatgaacgcgtccacgttcatctcatcgaacgttgagcacaattcgtcgaattccgtctgcgagcagagcgcctcgtgcaccatgctcaccgacatgaacagtccatgctgcctcgccatcgcctcaatcgaggaaatcgcggaaatcggaccataaaagcgttgcccgcccgcaaccaagccgatggtgcgggagcgatgcgaagcgagggcacgcgcggaattgctgggacggtatccaagcgcgtcgatggctttctgtactttttcgcgggtggcatcagacacgtcgggggaatgattgatgacgcgcgacaccgtttgatggctgacaccagccattttcgccacttcgaacatcgaggggcgtttgtttgccgcattgcgcttgcctgccatgctccgtcgccttccgcacactaccgttggtactttcgactattctacacgcaacttcggttagcgctaacagacgctatttttcagccatttgagcgagtcgcgcagcgaaattcggccagtcggtacgcatggcggtcaacagtttacgattggggacttcctcaatcggcacccattcgatttccatgctttcgtcgtcgttggccttcggctccacgcggtgccccggcttttcgaaagcgaacacggtggtgtaggcccacggtccgtggtcttcgcagtatgatccgaccacgtcgatatcttccggcgtgatgttggcttcctcgtacgattcgcgcagcgcgccctcgatcgggctttcaccgtcggcggtggcacctcctggaatgccccatgtgccaccttccgcgctccacaccgcgcgatgttgcatgacaacgtgcgtcacttcgccggtctgttcgcttcggcgggccaagagcacgccggacgcgccgttcgtgccccaatgcttgcggccgcaatcgcaatcaatccaaccatcacccggctgatgcacgttttccttgggaggaagcggcttcgcggcaccggttcgcgaatcgtgttcgacgttcggttcttgatcggctcgcgtcacattccacagatcagtccattccacgccgagctcggcggccaaacggcgcgccagcggaaggctcaggccgataatgccgtgcggatcgccttcgatggagtcgatgaacgctccgccgaagccctcaagcgtgaaggaaccagccacttccaacggttctccggtggcgatgtaccgttcgatatcggtgtcggaatattcgcagaagtgcagcgttgccctgctcgcgcctcgcgcgatacgcccggtggcgaagtcgatcaggcaatggcccgtccacaattcaccggtggcgccacgcatggcacgcagtcgttcccgagccacctcagcgctatgcggcttgccgtaacattcgccgtcaagcaggaacatggaatcgcagccaagaatcagcggaccgactttcgcacgggtcaggctcggcttgccatcaacgaaatcagcaatcgattcggtgatcgtaggaatggtgactcccgaaaaatcgcgggtcttcacatcggaggcggactgcacttcgtccgcacgcaacgtaacacgatgatgttctaaagatgcggaatccccagtattttcagcattatccgaatgttcggaagattcggcaacggctttcagcggaaatccgaccacacgatcgccgtgcgccgccgcagcggtggcggcaacgttccgatacgcctgatgtacggcttcggctttggccgtagcgagaatcatcacccgctgttccacgctcagatcgcttacggcaacgcccatggcggccgcctcacgttcgagcgccgccggctcgtccacgttcgatacgcgaatcgtggggcaaatgcccgccgagaaaagcacgtcacggcgaggcttggatttggaagcgagaatcagcggaatggagttgttcatgcgcgttccacctgcacacccttggtgtcgacgcccaaatgcagcacacgccaatgaccggaagcgagctcttcggaagcaagctgtcccagctgttcgcgagcgtcgccatgatgcagcacgagcacgcatgggccggcgccggaaaccatggaagcgaaaccatgggaacgcagcttttcgatcagcgtccacgacggttccatcaaaggagcgcgatacggctgatgcagacgatcctgcgtggcggcgaacagcaacgcgttgacgtcctgacgctgaccagtcgccagcatcgcaggattcatggcggccggcagcaggctcacgcgagacacattgtgcacggcatccttgaacgccagctggcccggcagcgcctggcgtgccttttcggtggacagctcataatccggcacgaacacggcggcggtcagatcgtcggcaacgcgatagttgatggtatggaagcccttatgcagcggttcgccgcccggaatcggcacggaaccgacaccttcgggggtttccatgtcccaagacatggtgagcccgccgtacacggccggagccacgttgtccggatggccttcgatggccgcagcaagctcaaacacggcatcacggttgagttcgtcgtcctgcgcgaaggcggccgcggctgcgatgcccgccacaatggcctctgcggaagagcccatgcctcgtgcctgaggaatgttgttgtgagcctgaagaatgaagcccacacggcccagaccaaaggtctggcatgcgcggcggaacgtggaaaccaccaagtgggtttcgtcacgcgggagagtatcggcgccttcgccttcgatcatcacctgagccgcagtgttcaccggatcggcgctcagcgtgaattcaagttcgtcgtggtagtccagagcaagtccgaccgtatcaaagccagaaccaagattggcgctggtagccggaacacgcacacgcactttacgagtaactggagtcatatctcgtcgtccttcgtcacatcttctttacaaatgtagcaccgtatacccgaaagggtacaagagtcaaattcaagcccataatcagcgggcgattgagtaaacaatcggcaagcaattgcccaacacagcagccggaatatgaataaagagacggccgcccaatcgcaacgatttgagcagccgtctcataactgttagttgagcacgcgaaggatggaaggctcgccaaccacgcagtcgagtgcacacacgtctttcacggtttcacgcagggtaagctcgtcggtcatgtgcgtgacaaggcgcagctgctgcagttcgccgtcgtagcccggatccttcagcgtgggcttgagatcctggttcacaccattgatggacacgccatgttcggcgaacttggccgcaatggccgcaagtacgcccggattgtcgtgaatcacgaaacgcaccgcgaactcggccttggaagcctcgatcggagccttcttcaaatccttatacaacggaatggtcgggccggtgcagccctgtgcgatgtgacgtgcttcggtcaccacatcgccgaccactgcggaagcggtcggagcgccgccagcgccacgaccgtagaacatcagatcgtcagccgcttcggccttcacgaacaccgcgttaaaggaaccatgcacggaagccagcggatgctcgttggaaatcagcgccggatacacgcgggcagacacgccggcctcgccattctccaccacggccagcagcttgatgaccttgttttcggcggttgcggcagcaatatcgtcggcggtgatcttggtgatgccctcaacggacacatcatcgatggtcacgttggtgtggaagccgagcgtggccatgatggccgccttgttggccgcatcgtagccttcgatgtccccggtcggatccgcttcggcgtatcccttggcctgagcgtccttcagcacgtcgtcgaaatcaagacccttggtggtcatttcgtcgagaatgtagttcgtggtgccgttgacgatgccgagcatgctcgtcaccttgtctccgacgagggattcacgcagtggcttgaggaacggaatagcaccgcccacggaagcctcgaagtagatatcgacgcccttggcttcggcggcggcatagatttctggaccatacttggccaacagcgccttgttggcggtaaccacggaagcgccggattcgatggccgcaagcacgaacttgcgggccacgccggttccaccgatcagttcgaccacaatgtcggcattggtggccacgctcatggtgtcggtggtcaccacggacttgtcgatccacgggaacgggtcggtttccgacggatcaaggcaggcgacgccggtcagttcgatcggtcgaccgatgcgtgcggcaagctcatccttctgctccaccagcaggcgtgcggtctgagagccgaccgtgcccgcgcccaacaatccaacgcgaatcggcgtaacatcttcctgtgccaaggcatcctcccttgaatgtgaagtattggtgtaaccctgcctattgtacggtctcgatatgacgtaagaccgcgaaatcatacgaaaatggacggtttctgagctttgccccgaaaaccgtccatgctgcatccatgttgcgtccgcaatttgagacgaatcgccatgaacaatacgaaacacgagcgaaacgccacgaatcgctattcgctcacatcccaatccagcagatcgtcgaccgtctgacggcggatcatcacatgcgcgtcttgctcggatacggcaacaaccgcaggaatcagcgcctgattgtagttgctggccattgtgcgaccgtatgcgcccgtaacaggcactgcaagcacgtcaccacgctgaatatcggcaggaagacgcacctcgttgacgatgatatcgcccgattcgcagtgcatgccgaccacacggcacagcttggtttcgctggaaccctcacgattggcgattctcgcagtgtaatccgatccatacaatgccggacgaatattgtcgctcatgccgccgtcgacagacacgtacacgcgttccgtaaccggattgccagccttgtctttcgcggttccggcaagctgcaccggcttgaccgtgcccacacgatacagggtgacgccggtcggggcgaccgtccaacggcccggctcgaacgagatgaccggagcgggcatgccgagcgcacggttcacggtggtgaccgcatcggcaaggcgggcaagttccgtatcgagatccatggaatcctcgccatcggtgtaggccacggaatagccgccgcccaagtcgacctccggcagggtgtatgcgtcggtggcgtagaaggtcttgcgcagcagcatcatgcgcttcgcggcctggataaaggcgtccgcatcgtgaatgttcgatccgatatgcgaatgcacgccgaccagttcgagcacgtcctgatggcggtagatctccttcaatacggcgagcgcggggccatcagccaccatggtcatggcttcggcgagtttgcggtcgccttcggaaaccttctcgtggctcatgtcgtacgggtatttgatgtcgtactgcagttggcgttctgcgctttcgcccggagtggcttcgctttcgcctaggcgtgcgttcgaccctgcgggggtcacgtcagccaaatcgtcgagcacgttcagcttgcttgcatcggcaccaaccggcagcaaggcgacaccgaacttctggtcctcatgcgcagtagacacgaattcgtggccgcccgcatgaatgccggacgtaacacgcaacatcacgcgagcgcgcttgccgagacgcttggcgatttcggcgatgcgggccggctcgttcggctcgtccaccacgattttggcgaagccttcggtaatggcgagttcgatttccgcatcggacttgttgttgccgtgcagcacgagtcgccgtccgggaacgcccgcggcgagcgcgatgcgcatctcgcccatggtgcaggtgtcgatcagcatgccggattcggtgacgatacggcagatttccttggaaagcaaggcttttccagcgaaactgacgtgggttacggtgttgttgaacgcatttgccgcggatttgacgaatttggcggcgcgggctcgcacgtcatcggtgtcgatgacgtagagcggcgaaccaaattcgttcagcaggctttcggcagtgcggccatggaacgtgatttcaccttgctcgttcacgttggagccggccggccagatgggggtgactgccatggcgatcacatcctgtctggggctgcgacgccaagcaggtcaaggccttcggcgataaccgtcttaacggcgtcattgagcttcaaacgtgcggctgcacgagccggttccggagccttggcgatgcgcagggcttcagcctgttcgccgcgagcttccggatcggtgagctccatgggcaccacgcgttccacgttgtaccacttgtggtaggtggcggcgaggtcttccaagtaatgggctacgcgatgcggggcgcgcaggtctccggcttcgcgcagcagggccggccactgggcgagcgcggcaagcacttcgccgtcggcggcggtgtcgagcaggctcacgtcggcaccctcgtaggtgatgccggcagcagccgcattgcgatccacattgcaggagcgggcgtgcgcatactgcacgtagtacaccggattctcgttggaatgcgaagcgagcaggttcaggtcgatgtcgaccggggaattgtagtcggtgcgtgccaacgaataacgggaggcatccacgccgatagcgtcggtcagatcgtcgatggtcaccacattgccggcgcgcttcgacatgcgcactgccttgccgtccttcagcacgttgacgagctggccgataagaatctgcatgttttcgccaggttcgtcgccgaatgcggcgcacatggccatcatgcggccgatatagccgtgatggtcggcacccagcatgtaaatggcgatgtctgccggatcgttgtcacgatgacgcttgttgcgatagtaagcaatatcagctgcgaaatacgcgtagttgccgtcggacttgataatcacacgatccttgtcgtcaccatgcttggtggattcgaaccaggttgcgccatccttttcgtaaatgtcgccgcgttcacgcagatcggcgatcgccttgtcgacttcaccatcggaatacaagctgttctcatggaaccacacgtcgaaattcacacggaaatccttcatggatttgcggatttcgtcgaacatcatcggcactgcacgcttgcggaattcctcacgctgttcggaatcgccctcacccagcggattgccatcgttgtcaacgccaccgtcgacgcgcggcaggtcgagaatcgcaataccgtcggcttttgcctcatcgatgacgcgacgtgcgatctcatcgatataagcgcccttgtaaccgtcgatcggggtttcctcaccgtgggctgccgcgaccagcgacttggcgaaacggttgatctgctcgccgtgatcgttgaaatagtattcgcgcaccaccttggcgccgttcgcctcaagcacgcgggccatggagtcgccgaccgcggcccaacgggtgccgccgatatggatcggaccggtcggattggcggacacgaattcaagattcagggttttgccggaaagatggtcgttcttgccgtagttcgcgccctcgttaagcacagtgtcaaccacggctgcggcggacgcggaatcaagcacaatgttaatgaagccggggccggccacttccacggacttgatgccatcggcattggcgagttccgcggcgaacagttcggcgaaatcgtgaggcttcatgccggccttcttggccagctgcatggccgcgttcgatgcccaatcgccgtgtgcgcggtccttcggacgcatgacggcgaatttggtctgcggagggatgagatcggtggtcagggtgccagccttgccttcattcacaaggttgttggcaatattgaaaatcagttcactaagcgcttctggactcattcctccaagtctaccgattatgcagacagaatcagccttgcgtatcgccccgcgtatcatcctgcagttcgccatgcttcctgcgccaagccaccgaagcgtaatagccgatatagcagatcgcaacgaacggaatcatatacagcaatgtggaacgctgcgacgaatcgcaaatcaccaaaaccaacgcgccgatgcacatcacaatcgcagcaatcggcacgaacgggaaaccgggggcacgatacttcaaatcgtcagccgaatgcccttgatcaagccactgcttgcggaaacgcaagtggcagacggaaaccgacgcccacaccaccagtgtggccaagccggaaaccgcaaccaacgccaaatacaccgtcgaagcggcaaccacggaagacaacaacgccaacagcgatccagccatgctgaacagcaccgcgaacacgggcacaccatggaaattcgtcttgccgagcatgcgcgggatcataccctcctgcgcaagcgaccagaccatgcgcgagcacacgtacaagccggaattcgcagcggaaagcactgccgtcaacaccacgaaattcatcacatcgccggcaaacggcatgccgatcgactggaacacgagcacaaacggactcgtgtcgacgcctgaccgatgccacggaatcagcgcggacatcaccgcaatcgaaccgatgaaaaaaatcgcaagacgcaacaccgtggtatgcacggccttcggaatcgcctgcgccggatccttcgtctcccccgccgcgacaccaacaacctcagtgcccgaaaatgcgaacaccaccgtcagcagcgtcgaaaaaatcggcagcacaccattggggaaccagccgtcattatagaaattctcaaacagcggtgcgtgatcgtaaccggcaatcggaatcgcaccaaacatggcaagcaagccgatcacaatgaacacgataatcgcaaacaccttaatggatgcgaaccagaattccgactcgccatacagcctcaccgacagaatattgagcatgaacaccaccgcaatgaaggcggcggaccaaatccacgcgggcgaatcaggaaaccaacgttgcatcagcagaccggctgccgtgaattccgaagcgagcgccaccgcccaattcagccagtacagcacggcgatggtgaacgcggtgccggggccgatgaaacgcttcgcatacaggtgaaagctgcccgcatacggcatggccaccgacagttcgccaaggctgagcatcacaaaatacacaagcatggatccgatgccatacgcgatgatcgcgccaagagggccggcttggtgaatcgtgtagccggagctgaggaacaagcccgtaccgatcacaccacctagcgaaatcatggtcagatggcgggtttccatcttgcgttcaagaccgccctgctcggcttcagcggattcagcggcgtcagtgtctgcagtggatgcgttgacttgcgattcggccatgcgcgactgctccttcatatttggatgggcgcgttcttgcgttcttgcgtttgcatgcgtttgcacaatacccaatcgcattactatacggaaatcggtggaatcatgttgcctgccgttcacttttagcggcaatcctgagattgcataaacaaaaacaggctcgcatgcagcgtaagaaaccgcatacgagcctgaaaaaggattttctggagatttgcaatcagcgcactgaaatcagagcacagcgatggcgtcgatctcaacgagagcgcccttcggaatgttgttgccgccgaacgcgacgcgggccggcttcacggagccgatgaaggtctgcgcatacacgtcgtcgatctcgtggaagtcttcgacgttcttcatgtagatggtggcgcggcagacgtgttcgatgccggtgcctgcggcgtcaagaatatgcttgatgttcttcagtgcctgggctgcctgctcgccggcggtttcgccagccagttcgccggtgactgggtcgatgcccagctggccggagacgaacacgaaaccgttggccttcacggcctggctgtatgcgcccagcgccgccggggcttcagaagtcgcaaccgcttccatcttctcgctcataatgttctcctttgaagaatgtgttatgcatgttgcttgcgttcaggccgcggcaaaccacgacaacgcaatctcaagcaatcactgtacccatggaatcgacacgcattgccccatgttccaaataccggctccctgccccggctcttcacatgtctttgtggtgggcttgatggggatcgaacccacgaccttctgttccggagacagacgctctatccactgagctacaaacccgtgcgtcaaactactttacactgccttgagatgaaagcgacactttttacggaaaaacgatcttcgaatctcggatcattattgcgaaaacatagctacggcgggtctttcgacagcacacccaaccctagaggggaaataacgggcatagaacggggaaggaacgagagatagcgtgcgccacaacgaaatttgtagcaacataacaccatttgaagcgtcttttccactaaactgaaaatatggttgaggattcaggcagaaatataggcgatttcgaatacacgcgccgttttttctgccgtgccctgccgacgcagttggatgataacgacagtccgacgctgatcatacaaagttattacgtgcatcaggataattacgcgctgcgcgtgcgattgaaaacaaagtccgtccgcattgccatgactccggacctcgacccgctggctgtgctcgaaaagtatcgcgacgaattccggcttggatcagtcaccgtgaaagggccgtccgtgggaggcacgcgatatgaggcgagccgcgatttggattcgcgcatcgcaggggagctcatcaaacgcggcggacacgtgaccatcaaaaaccgtttcaccgactggatcgatgaggacggctggaacatcgacgtgttcggaggcaccaacgctcccctgatcattgcggaagcggaacgtatcgggccggtcaccaatctggtgatcccgaaattctgcaccaccgaaatcaccgaccaatcgcggttcagcaatgaagggcttgccgcgaatccatattcacgatggaaatccgaattcgaagacgaactggaagcagacggaccgcaattcctcgactatttcggcaccaaccgtatggaataagtcttttaaaaaacaaccgtaggccgtaaagaacgatgtagttgcgcagcctacggttgagcggtacctaaaacggtacctaaagtcaataaacgagtcagtacatgagcgtggcgaggcgacggcgggcgcgcttcaaacgctcgtcggtcggctcaggaatcgtgaaatattccagcagacgcttgcgcaccggttcaatatcggccttatggccggccgcaacgaaatccagcaaacgatcgaacgcatcctgaatctgaccgccgatcatatcaatgtcagcgacggcaagctgtgcttcaacatcatcgggattgtcggcagcggcggcacgcacctcacgcacgttcgcattggcggaacgggccaacagcaacgccttcgcacgctcgcgggcggcacgcgcatcgttcggatcggcttcaagcaccttctcgtacgcggctgcggcgccagcgtaatcgccctgctgtgccagcatatacgcctcctgatgctccggaggcacctgctcctgggcgccggcagcggaagccgagtttgccgcatcggaattcggatcgccggaatacggcgcggaaccggtcacaccggcctgctgcgcggctgcgaccagattcggaatcaccgtatccacgatctgctgcatttcctcagcggacggcaagccctgcagaatcggcatcggacggccgttgatcaacgcgaacaatgcaggcgcgccctgcacttggaacgcctgcgcgatcgacggattcgacgcgatatcgatacgagacagctgaatctggccgttcagctggttcacggcatcgcccagctggcgtgccatgtcgaacaggcgatcatcggtcggcacccacagcagcaacaggatcgggaacgtggccgacgtctgcaccatggcctggaacgtgttctccgtggtgtcgatcacataaccgcctgcggccggagcgcctccagcctgccctggctcagccttcacctgatgcttcaacgcctcaagatcgacggctcccgccaaggaaactcccggattaaacggcctttgacctgccatgcttgcctcctagatatcaacaatcaacaacattaagcgcccggcgtaacacgcattgcaaacgttcgccccaagcttacgcgcattcgtgcgactgccacgatcacagtgcctcaacacgaaccggctggcgctcggaaccgactgcagtgatcttcgcgtcagaatttgccggaggcacgtacagcgcgaccacattcacatacgtggttttcatggtgctggtggcctgaccgtcgccaaacagcgctttttccgcatcggaagcaggctgcgactcacggccggagccagctgaacgcgtccattcggaattgatctgcgccaccaccagatcgccaccatccgcggaacgcataacgctgatggcatcgtcaaccggtgtgaacacctgctgctgcgatccctcgttcaactccatggccttctgcacctgttcggtcagatcggcaagcttcgtacgcaaatcgtcgtcggcaaacttctgcgcatactggctggacgcaccattctgcaacacgtcggcatacgcggcgaccgcatccttcggggtcatgaccagaccggtgtctttttccgttccctgctcgctaccggttttggaaatctcaaaactcggcatcttcacgcccgaaaacagtcgtgccacaccccacaacttgtagttctgacgtgcggaatcctggcggaacaccagcagacgcttggactgctggtcatccgtggtggaagtgatggaaaacaccgaacgcggccatccactgtccgtggaaatcacggcctgcgcaagatcagttggaatcgtggtcttgcggtcaagattgcccgtgacctgcgccacatgaagttcgctagtgcgaatctcaagttccggcccctccaaaatcgaaccgagggcgtcgatattgcgatcgttattgcactggtcaagcgttttgagaatattcatacggatggttttctcttgcttggcggtcagattcggcgcatcttgacgttgcgtggttttcggctgcggcagctgcccctcgcatccgcacatgccaacgaccattcccaatgcgagtacggccgccgcgattacgttgaaacgcttcttcatcacttggcctcctcgttgtcaggttcgtcggacttgtcgttgtcggattcgtcgttttcggatgtttcgttggatccgaccgactcggtcgttacggccatttcgtcaacttcgttgggcacgttgatttcatcggataccgcgaattctacagatcccgaggccgctgcggccgcactgctttcctcttgtgcgagacgtgcgaaatatgcggcaagctcatcttgcgaaatcacggaagtctgttcgaaatcgtcgttttcttcaacaccatcagcggcagcgttctgctgatcggcaacgagattgcgcgcgccgggatcgacaatcgtaggctgcgcaacttcgttttggctattttccgaaccactcgcgcgatgcccagcatgacgacgacgcttacgcttcggcccgctcttttcgctacgggcggcactcgcttcggcgttcttcacccatgcggcaacctcgtcatcgtcaccctgcgtggaaccgatgccgtcaaccatggcaaacgcgcgcttgttgcgacgcttatgcggaggcatggcaaacacggaagccgaaagcaccgcaagtatcgccagcaatccgccggaaagatagaacggcatggcgaaattcagcatcgaacgacggttccaatcaagtgtgaccgaacctcccttgcgatcgccgtaatcgataatcgcaacggaatcctcggcattattcgtattagcacccttgaactgcatatcaacggaaccggcattgcatttgacggtgcgccacatgtcggaatcctggaaggcgacctggccttcggaattatcggcggtgccctgagccgtggtcttcagcgtggacagggtggaccagtcggacagtccggtgacgcgcgtgtatttggatcccgcgatccatccggcgatatcgcgggcggaaccgatggcgatgcacacgttcgcggatttgtcgcgcgacttcgccgaaatggtgacgcgatcgtcaaccaattgcagcacattcggatcggtgaccacatactgcgatcccgtaaccgaggcggacgccgtgacctgtgccgagggcttccaaatcgtcgcgttcaagacgccaagcacgatgcaagcaatggcaagcaagccgaaaataggcgtgacaatgccgcgcataatcttggcgtgtcgcgtgggacccgccttggactgcggcttttcctgttcttcctgcaataaagtcatagcattcactattctacattgcctctctgcaaaagcctgaaaaaactatgaaaatcaatgattgccactaaagtggaacctatgcgcaaatctactcttttcaaagccgtcgcagccgcctgcacaacgatcatgtgcttgggtttcgcggcatgcggaagttccgacacgaagtctgattcctcctccgattcatcttcgtcttcttccgattcctcgtcgaagatgaatcagatcgccggtgtgaccgccacgggcaagcccggtgagaagccgactgtctccttcaaaacccctatgacggtggaagacaacagctacgtcgtattgcagaaaggcaatggcgaccagattgaagacggcgaccgcatatgcacgcagggtatcgccatcaatgtcaaggatggttccgaactcatgagcacctgggagaaaaacacccccgattgctctacggtggtcacctccgacaccagtcagatgactgaggattattacaacattttcaaggatcagaagcttaacgccacgcttgcgttcggtgtgaacgattcgaattccgctggcacctcctatttgatggtgctcacgatcgtgtcgaagtcgaaggatctgacgaaggcaacgggcacgaaggtgcttgacgttcctgccgatctgccgaaggtgacgcttgcgaaggatggcaagccgtcgatcgatatgaacggatacaagggttccgacacgttgatctcgcaggatttgatcaggggcgaaggcgccgaggtcaaggatacgcagaccgtgatcgcgcactataccggatggctgcttgacggcacacagttcgattcctcgtgggatcgcggtgcttcgtcgagcttctcgcttgatgaggtgatcaccggttggaagcagggcttggcagggcataccgtcggctcgcaggtgctgctggtcgtgccgccggaccttggctatggagacaaggattccggcaagattccagcgaactccacgttggtcttcgtagtcgacatcctcgccgcctactgatctacatcacgattcgcttataaaaactccctgcataacaacagggagttttttataagctagaagagtcgtagggagtcgtcttcggcacctttcatttcgtcatagtcgaggatcaggcagtcgaagccgcggtcctgagcgagcacgcgggcttgcggcgtgatggtctgcgcggcgaaaatgccacgcacgggggccaacagcgggtctcggttcaacagctcgcagtaacgggtgagctgctccacgccatcgatgccgccgttacgtttgatttcgatggcaacatgcttgccactgccgtcgatggccataatgtcgaccggtccgatggcggtcgggtattcgcggcgcaccaatgtcgcaccttccccgatgcgttcgatctgttcggccagatacttctgcagatggtcttcgacaccgtctttgatcagccccggatcttcgcccaaatcgtatgtttcgtcggaataaatatgctgcaatgtcacttcgagcacgtcattggatttatccgccgaagcacgaatgactttctgcggaacctccgtagtcacgtcgtcgtcggcatgttccggagtgatgtctttgatggtgcagggcgccgccatccagttgagtggcttgtacgaaccaagttcggagaaaatcagcagactgttatcggctttgataagcaacacacgcttggcgagcggcaaggacgcattcaaacgcccggaatattcggcagagcaatcagcaacaataattcgcacgaggcactaccctaccatgattgtcgtaagccatgaatcccacgatatgtacaatcctatttttgttttgattaatcctttttttttaaaaaaaacagtccgtctgctgcaactacagaatcgcaatcatatgcaattgctgcaatcgcaacagacggaccgtcagaagtatgctaccgagtgctactcggccatcttgacgtcacgtccacgctcaaccgcaacggtgagcttgttcgaatcgaaggagatgaaaccgtcggtcacttcgaaggagcgacggctgccatccggatccaccacaacgatggttccttccttgattacggtcaatacaggctcgtggttgggcaggatgcccattccgccttcagaggcaggaatggtgacggacttcgccgtaccgtgccacacggggtggtcggcggcgacgatgttcacctgcattgtcaatccggccatcacgcaccgtattccttctgcatgtcgtgccacttcttctcgagatcgtcgatgccgccgataccggagaatgcctgctccggaacgtcgtcgtacacgccgtcgcaaatgcgggtgaacgcttcgatggtctcatcggccggcacgtaggagcccggacgaccggtgaacttttcagcgacgtagaagttctggccgaggaactgctcgatcttacgagcgcggttcacggtggtcttgtcttcttcgccgagttcgtcgataccgatcagagcgatgatgtcctgcagctccttgttacgctgcagaatcgccttgacgcggttcgcgcaatcgtagtgagcctggcccacgtaacgcggatcaaggattcgcgaggtggagctcagcgggtccactgccggatagatacccttggaagcgatgtcacgggaaagctcggtggttgcgtccaagtgggcgaaggtcgttgcaggagccgggtcggtgtaatcatcggccggcacgtagatggcctgcagcgaggtgatggagtgaccgcgggtcgaagtgatgcgctcctgcagggcacccatttcgtcagccaggttcggctggtagcccactgcggacggcatacggccgagcagggtggacacctcggaaccagcctgggtgaaacggaagatgttatcgatgaacagcagcacgtcctgattttgcacgtcacggaagtactctgccatggtcagtgcggtcagcggcacgcgcagacgggtacccggctgctcatccatctggccgaagaccagtgcggtcttctcaagaacgccagcctcatccatttcgccgatcagatcgttaccctcacgggtacgctcgccgacgcctgcgaacacggacacaccgccgtggttctgggcgactcgctggatcatttcctgaataagcacggtcttgccgacgcctgcgccaccgaacagaccgatcttgccgccctgcacgtacggggtcagcaaatcgatgaccttgataccggtttcgaacatctgggtcttggattccagctgatcgaatgccggcgggttgcggtggataggccaacgctcggtgaccgtgatggtttcgtcatccttcttgttgaggatgttgccggacacgtcgaacacgtgacccttggtgacatcgccaacaggaacggagatcggaccgccggtgtcgagcacggtggcgccacgaacgaggccgtcggtcggcttcagcgccacggtacgcacggtagagtcgccaaggtgctgttcgacctcaagcgtgatcttcttcgtggtttcgccctcttcgttggcggtgttggtcagctcaacggtaagtgcgttgtaaatgtcgggcaggtggcccaccgggaattcgacgtcgataaccgaaccctggatacgcgtgacgcgtccagtggtcggctctgcagccgtctcgggagccgctgtggtctgattctcagccatatgcgttcctactcttccttcttattcagcgcgtcggcgctgccgatgatttcggtaagttcctgggtaatcgaagcctgtcgcgaagcgttgagcttgcgggtcaggtcgtcgatcaggctgcgggcgttgtctgtagccgtatgcatggcgttctgtcggcttgcagtctcggatgccgccgcggtgagcaggcattcatgaatacgggactggatgtacttcggcagaatcgcgtcaagcacttcgtcgacgctcggctcgaacgcataaagcggggtcgcggcatcggcatcggattcgggcacagggccggagtcctgctgttccggaagcacgagttcaacgggcagcatacgcagcacgcgcaccttctgaacgaccatattcacgaattcggtgaacacaatgtagagttcggaaactccaccttcgctcgccggcttcatgtaggcgtccatcagtgccttcgagatggactctgcgacttccacgccgggctggtcggtatcgccttcccaagtaccggcaacatcacgattgcggtacttgtagtacgtcacaccgcgacgaccatacacatacagttccggctgcttgcctgccgcatcgaggcgggccagcagcgattccgtttcgcggatgatcgaggaggtgtacggacccgccataccacgatccgaggtgagggcgaggacagccacgcgagggttgtcctcgtccttcttcacgatcggatggtcgatatgggtgtgggccaccagcgcttgcacggcgtcgaaaatcgcatcggtatacggcttcgcgttcaaggcgacgtcacgtgccttggcgatatgcgaagacgcgatcatctcctgcgcgttgaagattttctccaacgacgcggtggaggcgatcctagatttcaatgcgagttgcgagcccatggatcacttctctcctgcgacgatcttttcctgctcgaccggggtggcgttcttgacgttaggcttcttctcgaccagcggcttgcccgcgctggtcacgaaagtctcacggaacgcttccacagccttgtcgagggcagcctcggtgtcggcggtgaaatcttcggtctcgcggatggtcttgagaatatcggtgttgtggtccagatagtccagcatggccttctcgaacggcagcacgtcgttcagcggcagatcatccatcttgccatgggtgccggcccacacggagacgacttcctgttccatggaatacggggagaactgcggctgcttgagcagctcggtcaagtgggaaccacggttcagctgggccttcgaagccgcatccagatcggaagcgaacatggcgaaggattccagggaacggtactgggccaaggagatcttcagcgtgccggagaccttcttcaacgccttggtctgtgccgcgccaccaactcgggacacggagatgccgacgtcgacagccggacgctggttcgcgttgaacaggtcggactgcaggaagatctgaccgtcggtgatggagatcacgttggtcggaatgtatgcggacacgtcgtttgccttggtttcgacgatcggcaggccggtcatcgaaccgccgccgaggtcatcggaaaccttggcgcagcgttcgagcagacgggaatgcaggtagaacacatcgcccgggtatgcctcacgtcccggcgggcggcgcagcagcagggagatcgaacggtaggcttcagcctgcttcgacagatcgtcgaagacgatgagcacgtgcttgccgttgtacatccagtgctgtccgatggcggaaccggtgtacggtgcgatgtacttgaaacctgcggaatcggaagccggggaggccacgatagtggtgtactccatggcgccggactcttcgagggactgcttcaccgatgcgatggtggagcccttctggccgatggccacgtagatgcagcggacctgcttcttcggatcaccggattcccaattacgcttctggttgatgatcgtatcgattgcgatagcggtcttaccggtctggcggtcgccaatgataagctggcgctggccacggccgataggcgtcattgcgtcgatggccttcagaccggtggacattggctcgtcaaccggatgacgatgcataacgtcaggtgcctgggcctcgagaatacgacggccttcggtcttgatctcgccaagaccatcaatcgggttgcctagcgggtccacgacgcggccaaggtagccgtcgccgacgggcacggagagcacttcgccggtacgacgcacttcctggccttcctcgatacctgcgaagtcgccgagaataaccacgccgatctcgcgggcgtcaaggttgaacgccaggccaagcgtgccgtcttcgaaggtcagcagctcattggccatgcaaccaggcagtcccgtcacgtgcgcaatgccgtcgccagcagtcgcgacataaccgacttcctgagtcggggtatccgacggcttgtacgactcgacgaactcatcgagcgccttgcgtatcgtggtgggatcaatggtaagttctgccatgatcactccttattgttgtttataaattcagtcaagtcttgtttcaggcttgttcaccgtgcggcgaaccgtcaggcggttgccttcaccgtgcgctgaagatgctgcagctgtgcgaccaccgtgttgtcggtgacctcgtcgcccacctggatgcgcatgccacccatgacggtcggatcgaccaccgagttgatgtgcaccggatgaccggtcttcgccgagtaaatggcgatgagcttttccacctgctccttgctcaacggcgttgccgtggtaacagtgaccatcgattcgcccatatggcgggagaatttgttgatcagccactgaatggtctgcaagtagcggcgattgcgcagattgcaggtcgcgtgttcggccagacgcttggtcaccttggtgaaatccgtgtctccaatcaggctgtacagcagcttgacacgggcttcactggaaacggttgcgtcatacagcttggtacgcacgaccggaaggttgagcagtgcggaatgcaactctgcgagctcgatggagacctgcaaagtcgtattggtgtaatccgcgtagtacatcatgccatcaacgccgaaatcctcaacggcattggcgatatcagacacgcggctccaacggcgagacaccagatcggacatgatctccatcacgagcggatgggcctggtctccgatcagagtcttgactaccgcaaccttgtcttcgactgggcgcgacgggtcggtgagggcacgttcaagctggatattgtggtcaagcgcgctggtgatcgtgaacagttcgttcccgatacgccatgcgtcctcaccgctgtcacgcagcttgggggccagcgagtcacgcgatacgcggtctgcgatacgcgatgcttctcctcgcattggtcacctccctttcttgaaggtttcgatcacttcttgtcgctgtccaagtcggcgatcatctggtcgatcatcgacgactgcacatcgtcattctcgagcttgctacccaggatcttgccggccagtgccgttgccagcacgccgacctcacccttgaggctcaccagagcctgctgctgctgcgattcgatggaacgctgggcggtggcggtgatctgcgccgcatcgttttcggcacgagtgcgcgcgtcagcgatgatatgcgatgcctccgtacgtgcgtcgtcacggatcttggatgcctcgacgcgagctttgctcagctgagcctcatacttcgccttggcttcatcggcatctttctgggcctgttcggccttggcgatgccaccttcgatcttggcagcgcgctcatcgaacacggcctggaacttcggcaggaagaacttgtagaagaacacggcgacgatgatcagaatgaccaacgaccagaaaatgtcgtagcttttcggaaggaacaattccatttcgctagctgcggtcaccatagtgtcttcctcctttcatgttcgtttgcgtcttcggtgttaccttgaatcaagtcttacttgatgaaggcgagcacgaagccgagcagtgccagcacctcgacgaatgccagacccaggaacatgagggtctgcagacggctgccgagctcaggctggcgagcggtgccttcgatggtcttgccgatcaggatgcccagaccgatgccagggccgatggcggcgaggccgtagccaacgacgttcaggttgccggcaacctcagcgagggtaacgatatccatgattgtttcctttctggttattgcttgacaagaagcaacaattaaaaagccggcggtcagtcgatctccggatagctcatattgatgtatgcggtggtcaggatggcgaagatgtaagcctgcaggcaagcgaccagcgcttcgaacaggaacatgaacatgccagccgcgaaggtgacgacgccgaatggcatgaacaccttgttcaccacatcaatgaggaagtactgcgtggccgaaaggcacagcgcaagaatcaagtggcccgaaaccatgttggcgaacagtcggatcgtcaacgagaacggacggataatcagcagctcaagcagctgaatcggggacagcagaatgtagatcggggccggaacacccttcgggaagatctcatccctcaggaagtgaccgaggcccttttcacgaatgcctgcaatccagtattggcagaagcaccacatggcgaataccagcggcagcgtaatggttgcgcttgccgcgatattgaagcctgggatgatgccacacagattgaagaccaacaacgtgcagaacacggtggtgatcatcggcacataacgcttgccgcgcagctcgcccatcacctgatagacgatgttgtcacggacgaattcgatcaaccattcgactgctccctgccaacggctggggatgagctttgcacggcttgccgtaattccgagaaccagcaacatgatgacggtcgcaaggatgcgaacgaggatgatgcggttgatggcgaacggcgtgccctgaaaaacgaacggatcgggaaggaagtcatcgacactgggcatttcgggaccatcagcgatggtcagcatgccctttcccaatgcaccaatcattcacgcctcctgctcttgtgtcagctgttagtttaacccaacaaccgagtcgaatgtgacgttctggttacttaaccaaagcgtacttcgaagtgcgcgtcgacgcgaacggagtcccgtgcgacgcattcgactccgaatggctggataggattattagcccgtgtctagacaacatccacacacttgggcttttccatactcccatttggttttcccggcgtttcgcagcaagctgtactaactagacacagctttgtgaatcgtcggatagccgacgcaaccaatagtttgttttacgaaaacagcatattgataaaacgtttcaccaagtatatcacatataacacaggtgctgcatataaagaaagaggggccgcatacgcaagcccccaccagtaaacagccgtaaagtcacgcgccaatcacggccgcacgtcaatcacatcaatatgcggatcaatccacaaatcaatcgcgaatcacgccataaccgtcacgcacgaacggcgcaaacgcgtcgacacgcggcgaacccggctgatgacgaatcgaacgatccgtgccaagacgcttctgcgcacgaagctgcggaacctcgctcaaatcgtatggcgtggtctgatacacccaattcagccaattgcgccacaggagattggcatgggcgcgccacgcgaacaccggctccaactgcggatcatcatgcgggaaatagttttcggggaacggcacattcgtcatgcccttcttcatatcacgctcatactcctcggccaaggtgtacttgccgtactcccaatggccaagcgcgaacacttccgaaaaatcacgagtggcgatcagcccaggaccggacttcggaccccacgtgagcacctgcaactccggattgcgcgcgatatcaccctcgtccacccccgcaaggcgagaatgcggctgcaggcaaatctcatcgaagccgttcgtcaaaaagcagtattcatcctgcaaatactgcggaaacacgccaaaaatcttctctggcaaattctctttacgcacgttatagcgataattgagcgcacccatcgcaccccagcacaaatacatagtggagaacacatgcgcggaagcccagtcaagaatctgcttgaactcatcccaataatcgacctgttcgaaatcaagatgctcaacaggggcacccgtcaccacgaagccgtcgtaatagttgtcttggaacgcctcaatggtctcatagaacttcaccagatggtcggcgctcacatgcgtaccctcgtgcgtggaggtcttcatgaaatcgatctccacctgcagtggacttttcgagatcaaacgcagcagctgcgtttccgtctcgattttcttcggcatgagatttaagatcaccagcttgagcggacgcacgcgctggcgctccgcttcaggcttttcaagcgcgaaaatacgctcggagtcgagaatgtctctggccggaaggccgctggggatcttgataggcatgcttctattatggtgcgggctcggatatggcgcacttccctgcccccacgatcagccgaaaccgttataggaaaaatgaataacgcgctatttgcaacgcggttttgcatggccggactgatgcgacacgccgatttgacatatttggaagtaatcgtaaagttaatagagctgtcttaaagacaagccgacgcggggtggagcagctcggtagctcgctgggctcataacccagaggtccatggttcaaatccatgccccgctaccaacgcctcgggcttcacatgaaagaagtccgaggctttttctatatcctcaaggctccatgccactcgcctagtcatcttctgtgaaatcgaagacctatcgacaccaagagcgttcgccagatccttttgtttgacattgcgaagagtcatggccactttcatatttcgagtgactatatcctgcaaactgacagattcggcctgagctgcgaccttagggctgattattgctgttgtcatagcacataagtttagcgaaactaacaaaaagatagaacacgacacgccgaacgagcaggtctaactatattcgtggttagatgtgagtgtgacaaacattttagtagattcgcccactgtaggtgaaaaggtcaaacgccttatgggactcaatggcctgacacaggcagaagtcgctgaaatattgcgctgctcacggtccacggtctcgcagaaatgcactggccgaatcgctttcagcgcgaatgagataaacgagcttgccgaactcttgcatgtcagcgccgatgtactccttgggcgagctccgttggaggtgaaatgatggattggcaccttgttttgtcgtcgtcggcatttgccatttctgttgcttcgctcttggtgtcgcggcacgcttggacgatcgcagaggaagcgaagggcaaggcccgtcactcgttgagagtgtccgtctattcggtcgaagttaaccgcaagcggcttggtattccctatgaccatgatgtggttgaacagtacgaggccaatgagggcatttttgccagcatgggtgtcggttcctataaaggcaggcgatgcaaggattcggacggtatcgtgcagtccgacgacgccgtacaggtgttctcggacggcacgtatcggattgttcctaggacagaatctttctctgttctaaagcccgttttctgtcgagttcatggaacctgcgatgacccttcctgtccctatgccatctccgcagtcgttccaagggtccgcacttccatggttctatgcccagcaacgggaactgtctatatcgacaccggcgcagacgagttggagatgatacccaatgcacgccaagctctagtttcgtcagatcgggttcaatgtcgcgactcgaatcgcggggcggtgtgatggtgacccagaatcgcattgtttcgttggtcaactcgactattcgaccggtgttgttcatgatccatttggtttgttcgcccagcaccgtttcgcctatctgccggcagtcccacacctcggcatcgcagtttatgccaatggctttgacgttgagtgcccgtccatccccgcagttggccagccatccgatgaaaaccgggtcaccgtcggcgcgtttgaactcgggaaacaggagcatgtcgccttgcacctgcacgaaggcgggttcggcctcggaacgccaccgccatgcgcgacggtatgtggccaacgatacaaggaacgccagcacggcgataaccacgctcgccactggcgcgttggctttcagtgcgtcgatggcgttcctcagtagctcgaaccgtgtcaggtccacgtccatttattcttccttccttcgttgtttgaaaggtttggtttgtgcgattacaagcctatcgctgcggaggaaggagcctaaccgtccatccatgaatcaaggagcagtgaaatgagcgttttcaatccggaatgcgccagcggcaacccctacgccttcaagtgccgcatcaaggtggccggaagcacgttcgggttcgatggcttggacatgggcgaccttcagacgatgaagggcgcgatcaaccaggcgatgacgcacgcgcgtcgagctcgccgtgaatgggaaggagcccaggaatgagcgtcacagtcaaacgtgtggacaggaaaagcagtcagcgtttttacgagctgatcgttgagacggcagaagtcaccgtgcgcgtcccgttcaacggctacgagcttgacgatcttgagaaacagatcgaccgatgcttcaacgaggattgacgtgaaacgtttcatcaagttcgttcttctgattctgctcagccccttcgtgttgttcatgctggggctggtgctcgcgatcgtccgtctgggtgatttcctcaccgacgacgactgacaaaaacgaacggcatatggggcgtatggcgtacccctgccaccgctgagccgggttagcgaccggtaacgccaggcgcgtggctatcgcgccatttgcgagacgaaatttagctcccgaccctctcaggccgtcgattaaggcggaatcgggcgaccatagacggcttcggccgtggcctgattggggaccattcccggcggcttcggccgctcttgttatcgacggcgcggctccgaccgaaacgttctgcaaggcctttggaatctgttgacggcctggccggggaatctcggccgagcgtttccatcagcagattctaggtcttgacctctcaagcgctcaccaaccgaaagctacaggaaggattgaaattgagcaaggcaacattccccgacaaactgaggacgcagatgaggatgacactcccgatgatcgacaggaacatcaggtgcagggcgaacacctcacgacagtcgttgatgaaggcgtccggattgaacgacaaccagctccaggccgctctgaaaatggcctacggagagaggggcgtgccagctcccgtctaccgttctcccgccgccggcaagatgtacgattccgagtctctgctgttgacgctggccaaatggtgcgggatgtggtcttatgtcatcgattaagccgacattgcacgaggtgttgcactatccggaggaatcgcgcaggatgctcatgcagggcttcgccgacgctgtggaccgcatcgcggcaaacaaccagcgcaccgacatcgaattgttccaggtctgccgggcgctcggcgagccgaacgtgccatcgctgctcagcctcaaagatgatgggctgccggtctaccgggccggcacctggcgcatcgactgccgcagcttccgcaaatgggcaaccgcctacacgccataccggccgcagacgaaaccacaaaccgcatatgaaggtgagccactgttttgaaaccgcagatctgcatcgcactggacatcgaggaccacgacctgccgcaacccggcgacgtggagataggccagaacatcatctgcccggacgggccgcgcatggtctggtcggacatctcgaaggccgactggccgattgtcgccgcgaagctggaacagatcgcgctgctgctcaggagcaaggcgagatcgtgacgtgcatcaggatgttaagcactgctgaggcgtccgaacggttgggcgtcagccagcgcacgctgatccggtggcggcagtcggtcccgatcatcggacctccgcccatccgtatcggcaacgccatccggtacgcggaacaggacgtgaattgttggatcctcacgcaaagggagaaaggcaaggcatgagaagacagacaatagacccgcgcatccgcacgaaggtcatagcgacgtatggaaaccgctgctggttgaacatgcccggctgctccatcaccgcgacggaggacgaccacatcgtaccgtacagccacggaggcagggacaccgtggccaacatacgccgcgcgtgcaagcattgcaacgcgatgcgccaggaccgcgtgctgtccggatacggcgcgacattgcacgctgtcataggaccgccacgggccgacttcggcatggccatgcagtccatgctccgccgtgacagcatcgttgtcagcttcgacagtctgctgcgcgacctgtgcccgacgcaatccaaagcgaccgatgggctgcgcctcgccgccgcgatggcatgggacggcgcggcccgcacactggccaagagctccgagccgttggacgtatggctggtgcgcacgctgccacgctcccgccgccatcccgacatgctggccgaatggctggcattggactacgatgtgcacgtcatcgagacaccggccgattccacgttcgctctcgacctcacgccgcaggagtatcggacggcgcagcagtggtacgcgctgcatctcacacagcaggccgtggacgccaggctcgccgccagacgacaacgcctcgccgctctcggacttcgccgcgactctccggctgaccgtccgcgatggtgacccgcttttttaaacagccgacgcccaaaagaccccgcgccaagtcttttctccccccagaaccatgcaaaaaagcatgaaaacgttggaaaaccaaggaaaacacatcatgaatcaaggaacgttggaaggtttcgaggaatacacgcatccctacggcatcagcggccttcaggagcaggcgaccatgaatctcatcaaaagcttcgtggatggcaagacgttgacgccggaagcaacctacatctgcaagtcgatgctctcgatagccaggaacatcgacatccagaacagcaagggacgcgagatcagccgcaacatgacatcactgctcacatggttccaggaactcaaggcgatgtatccggaacagccgcagctcgacccgacgctgaccgacttcatctccgacgcgaaggccggactgtgaccatgctcatgcgcggcggcacgaaacgcgacgaaacgcggccgaccgacggcgcgatcgtcgcacggactgccgagatgctcggcaaaccgctgctgccatggcaacgctacgtggccgacgtggccggcgagatcgacccggccaccggaacgtactattacgaccgcgtggtgctttccactccgcgccagtgcggcaagagcacgctgatcgacaccgaggacacacgcaacgctctgctcggcccagaccggaagatctattacctcgcgcagaccggcaaggacgccgagaagcatttcaaggacttcgtgcagcagctctcaaaatcgaagctcgcgccgttcgccctcaagccgaggctttccaacggcgggatggagcagcgtttccgcaacggcagcttcatctgcccattggccgtgaccaaagtggccggccatggcacgcagatggacaaattcaccatcgacgaggcattcagcctggacgacgagaccggcaaactgatcctcgacggcatggcaccgaccatgaacacgagactgcacttcaccggcgtccagccccagatctggataacctcgaccgaaggcaccgcagattccacgttcctcaacggcctgctcgactccttccgcgccggaaacgtgccgaaacgcacctgctggttcgatttcggcatccccgacgacgccgaccccgaggacttccagacgatcctgaaatggcatcccgccgccggcctgctctgggacatccgccaattgcgcgacttccgcgagcagttcgccggcaacgaggccggttgggcgcgcgccttcggcaaccggcgcgacaacggagtggccgagcgcgtcatccccgaccagctctggcaatccacgttggccacgccgatcacgccggaccggatcgacggccggtcggtggtgatagccgccgccgtggacgtggacgccacgaacacgtcagtctccgccgcgatcgtcaacacggacggcaccgtgaccgtgcaactgctcgaagtcctggacggcaccggcatggcacccgccgagatcacgagaatctgcgacacctaccacgctcccctggtcatggactgcaagggaccaaacgccgacctgcacgaccggctcgcatccatgaccgacgaagccggcgatccgcttatcgacttcatcgccatgcaatcatccgactacctcgcggtcggccaggcattcgtcagcggcctgcggaacaagctgatccgccacgccgccgataccgagctcgacgcaagcgcggccaactgcgcgaggacgtggagcggcgacgcatggcgcgtcacacggcgcggcagcaccgggctgacatcgccgatcgaatcatgcatgctggccgcgtggggcgcgcatcacctgccatctgactgcacgttgcaaatcttctgacgtgtcaccgtttgtcaccgtttgtcaccgtttgtcaccgtttgtcaccgtttttttggcagtgacggaaccacggccatatcctcggcgtcatgaatctttgggaacgcatgaggctcgcaggccgcgtgctcacgcgcggcgcggacggcacggacatgccggacggcatcaagccgccgaaacggcggccggccaccgaaccattgcaactctcaaccgtgttccgtggcgtgcaggtgcttcagaccgccatcaccggcctgccgatcgtggaacagcgcggcggccgtgacctgccggacgtgagccccatggtgttgcagccggacgtgagccgatcacgccgtgatttcatcgccgacatcgtggcctctctcgtgctcgacggcaacgccttcacgcgcatcgtgcgcgattggaaaggcgagatcgtcacctgcgagatactgccgccgcaatacgtgaccgtcaccgacgaaagcgacgacccggcacgccccgacctgcggttctcctatctcggccatgcctacaccgccgatgacgtcgtgcacagcaaattcctcaacgtgcccggccgactacgcggactcggccccatctcggcggcacgcgaggagatcgatgccgcgcagctcgcccgcgactacaaggcgaagttcttcacggacggctcgaacctcaagggctatctgcgcaccaccgagaacgtcacgaaggaaaccgcgcagatagcgaaggacgcatggaagagcgacggcacagccggagacatcaaggtggtcggcaaagccctggaatatgtgccactcgacatgaaacccgccgacctgcaattccttgagacccagaagttcgacaccacgcagatcgcccgtctgctcggcatcccggcaagcatcatgctcgccgccgtcgatggctcgaacctcacctacagcaacatcgaacaaagctggatcgaattcgccgactacacgctggccgcctataccggcgaaatcgaggaaatcttcaaccggctcctgccgcgcggccgtaccgcgaaattcgactgggacagctcgcagcgcgcgaacatgagcgaccgatacacggcctacaagacagccatcgaggccggtttcctcaccgtcgatgacgtgagacgcaaggaaggactgccggaactcacgaaaggagaagaccaatgaacatcgagaaacgcgaaatcgcatggaagggcctgacgctccgctcggccgatgactccggcacctcgaccgtggaaggcgtcgccgtgccgttcggcgacatcatcgacacatgggacggtgcggagaccttcgaccgtgattgctctttcgagggacttgacgaggcgaaactgtgcttcgagcacggcgagaccatcggccgcatcaccaaagcggaaagcacggacgacggactgcacatcaccgcgcggatcagcgacacggcacgcggccgcgacgccatgaccctgatacgtgacggcgtgctcgacagcttctcggtcggtttcattccgatcgaatcgcagaaggaccgcgacggcatcacccaccgccgcaaggtccgtctgcttgagaccagcatcgtgagctggccggcctaccagaacgcgaaaatgaccaaatcagcggcaccagccgtggaacaaaggaaggaaaccatggagaacaacaacgaactgatggacctgatccagtccatgcaggaggagcagcgcggcatcaaggccgagatcagcaagatgggcgcgaaaccggcaccggctgccatcggcgcggcgtaccggagccacggcgaatacatgcaggccctcgcgcgaggcgacgaacaggccatgaccgtgatgaaggaatgccgcgacctgatttccaccaaggacaccggcaacaccgccacctggatcgccgacgacctcaaactgatcgaggaccgccgcaaggtctcacagctcctgacccatgacacgctcccggcgaccggcatgagcatggaataccatgtcgtgacctccgacaccacagccgtcggcaaacaggagacggaaggctcagagctttccgtcggaaaagtcgccttcggcaccaagaccgccgacatcaacacctacggcggctacacttctttgagccgccagaccatcgaacgcagcaccacgccgatgctcaacaccgcgatcaccgcattgcagaacgcctacgcgaaggccaccgagaaggcagtgcgcgaccacctgtacgcggagatcaaggcgcagcgcgacgcatcctctgacgccaacaagatcgacgcgccacagttggccaacatgaccatcgacgattgggtgtcgctcatcatcgacgcgtccgaactggccgacgaccgcaacgtgtcgctgacgcgcctcgcggtctccaaggacgtgctcaaggcactggtgaaactcaaggataccggtgaccggttcttcaacctcagcggcgacgggtcggacaccatcggaagtttcgacctgaccggcgtggccggcacgttcatgcgcgtccctgtcgtgctgctgccgaacgccgatgccggattggccagtttcatcgatcccgccgccgtgaccgtctgggagtccggcggcccggcgcagttgaccgacgggaacgtgaccggcctgaccaacagctacagcgtctacgggtatatggcggtggccacgacccatgcggacggcctgattccggtgaagttcgccgcggcatgatgatcgatgacaacatcctgctgcaacggctccgcgacgaggttggagtgccggccggagaggacgaacggctcacggtcaaactcgcggcggcgaagcgatacgtcgcgcacgcggtcggcaccgccaccgtcgatgacgatctgctggccgattgcatcgtctcctgcgcggcggacctgttcaacatgcgtgacgcgcgcctgggcgtgatggacgtgggcgattcgactgtggaaccgttcagaatctccaccgacccgctccgctcggtctggccgaaactccgcgccgccggcgtgctcaccgggggcatggtgattgcatgaacatccaggaacaacgagccgcgctgatgaacacgctcaccgacatgctcgatggactggtcagcagcgtcagcatcgacgcccaactgatccgcccggcggccggcaaagtcgcggtgttcatcgaaccgccaaccgtggaatggccatcatggggcccgccggaaccggtctggacgttggacgtcatcgccggcacgccggccacgcagccatccgcagtcgatgacatcctcacagcgctcgaccggctcgccgaacgtggcctgaacatccagaaggccacgcccgcgacttggaacctcgcaggagccggcacgctggcggcctaccaggtcgtgctgaacgctctggaaaccgaataagacaaggaaaggaaaaaatcatggctggaaagatccgcacgctcggaccaggcatcttcaaaatcaccgacaccgaaaacggcagggacttcagcgccgacctgaccaaggcgcagctaaacccgtcgaacagcagcgacgacccgaccacctacctcgacggatcagaggagacgaacaccacgacaacatggacgttcgagggcaccgtgggcgacgacttcagcgaggacggtctggccgtctggctcttcgaccacaagggcgagacgctgccggcccagttcgtcccgaacaataccggcaagatccagtggaccttcaacgtcaccatcgcgccaatcgccatcggcggcgacgtcaaatcgaagaacacgaacgatctgagcttcgccgtcacgaacgtcgcccacgcaccgtacacgggcaagtgatgagtgatggctgacaaggcattgatggtcgtcggccagaaacgcttcgttcagacgatgcgcaaggccggcgcggacatggacgacctgaaggaagtgaaccgcgcggcagcgcagatcgcactgcccgccgtccgcaacctcgccccacgaggcaaaaccggccggctggccggcagcctgcgcgtcggagcgacgaaacgcgccggcgtcatccgcgccggccgcaaggccgtgccctacgcaggaccagtcaactacgggtggcccgcccgccacatcaagccacgtctcttcgtcaacaacggcgtcgcctccaccgagagccaatggcaaaaggtctacaaggacttcatcgacgagacactggagcaagtgaaaggaaaataatggcaaccacgagaatcacctacacggacggtaccagcgagaccgtgccgatcacgatgcgcgcgacatgcaaggccgaggcgcacgccatcgacatgggctgggggccaatcacccagtcacccgtccgttccggcgcatacgcggcctacgcggccctgcgcatggccggccgcaatctgccagacttcaagcattggctggacaccgtggcctcattcgacctcgctgccgcgaaggaggaaccggaagagggaaaccctacggactagccgcgtggccccaagactcgcttggccgtctctcattcctcctggcgagccgtttcggcggcacgccatggcagtggaggaacgaggccgacgaattggattggggcaccggactggccgaactgctcaaagaagccgaatcacggaaggagtgaaccatggcgcacagcgcgatcatgagcgtgcgcatcaccggcaacgccgatgatgccgtcaaggcgttcgagaagaccactacgaaggcggccgctttcggcagcgccatcggcggattggccgtcaagggcgtgaccgcgctgtgggacacggtaaagggcttcgccggcgatgtggtgaacatgtcggacagcaccgacaagttcatgaacaccatgagcttcgccggcatcgacaccaaagccgtgcaggcagccgcgaaggaaacccgcaaatacgccgacgacaccgtgtacgggctcgatgacatccagaacaccaccgcgcagctcgcggcaaacggcatcggcaactacatggaactgaccgaggcggccggcaacctcaacgcggtggccggaggcaacgccgacagtttcaagagcgtcgcgatgatgctcacccagacggccggcgcgggaaaattgaccacggagaactggaaccagcttgccgacgccattccgggcgcgtccggcaaactccaggaggcgctgctgaagaacggcgcgtatacgggcaacttccgcgacgccatgtccaagggcgagatcaccgcagacgagttcaacaaggcgctcatggacctcggcatgaccgacgtggcgaaacaggccgcgacatcgaccagcaccatcgagggagccatgggaaacctcgaagccgccgtgaccggcggtctgaccgacgcgttcaacctgttcaaaccggccgtgacgggcggcatcaacgccgcatcggccgccgtgaccagcctcgctaccaccggtgtccagggattgcagacgttcttcggccaggtcaaggacaccggagcgttcacctcgctgcagtcgtccgcgcagtcggtcggcggtggactccaatcactgtggaccggcatcatggccgtcgtgaacgcgatgaccggaggacagcccgccggaaccgcgttcggcaacgcactcaacaccgtcgcaaccgccgcgcagacggtcggcggctggctgaagaccgcaggcaactggatcagccagaatctggatcttgtgaccccgctcgtcgccgcgatcggcggcgcagtggcagccgtcaccgccgtgaccaccgcaatgcaggtcgccgccgtcgctcaggcggtgctcaacgcggtcatggccgcgaacccgatcatgctggtcatcacgctcatcgccgcgctcacggccggactcacctacttctttacctgcaccaacaccggccgggccgtgtggtcgagcttcacgagtttcctgggctcctgcgtgcagggcatcaccggtttcttctccggcctcggctccaccatcgtcggcatcttcagctcggcggcgaacggtgccaggaacgcgtggaacggcgtggtcggctggttccgaggcctgccgggcaccattggcggtttcttctccaacgccggcagcatcctcgtcaacgcaggcgcaagcatcatcaacggcttctgggacggcctcaaaggcgcctggaacaacgtgaccggctggatcagcggcatcggcgactggatcaaggcccacaaaggcccgatcagctacgaccgtcgcctgctcatccccgccggccaggccatcatgaccggcttcgcccagggcctcaacaccgggttcgacagcaacgtcgaaaccgccatcggccgcgccaaccgcagactagcggccatgccactcaacctctccgcccaaggcaacacggccacgccagccgtgatcaacacctggaacgtggaaatcaacggcgaggtcatcgacaaggacggcaccgccaaggccatcaaacggctcctggccgactacgacgcaaggaggtcatgatgcagcagtgcttcatgttcatcgacaccggcaacggcagcggctggacgccggtgaacgattccaccaaggacatcgcggccctagactcgttcgtcatcgactggggcagcgacggcatcgacgaacagcccgaacctgccgtgatgtcgttcaccctccgcgaccgcaccggacggctcgcaggccaggcactcacattggccggcatgaaggtgatcgtgcagttctccgatcaacccagatggcaagatcttcagccgtcgatgggctgctggcgcgatctgcgcatccccatcgactcgctccataagacttattcgccagactcgccagactcgccagactcgccatccgaaacaatgttcggcggcaccgtctccaccggcggcagcatcgaaccggccagcgacggcggatggctgctcaaactctccgccacatcgaggatggccgtgtggaagcgcctgcaatcccaaggaccgacagacatggccgcgaaatgggacggcgcgcactggataggcacgccatccgcacgcctcaaggagatgaaccgcagggcctcggcgcagggagcgccggaagcccacctggacgggctcgccctgccgtcaagcgtcgcaccatacacgccatccgaccacccctcgcagctcgacctgctgcaccggctcaccgtcgggccacgactccctcaatggcacgaagtctacgacggcgcggcatccaccatcaggccgctgttcctcgccgacccgatcgccgtgcatctgtcaaccgatggccgactcaacgtcctcgccgacggcgcgacacgatacgcgctctcggcggccgacatcgaggcatcgacggatctgagcatcaccgaacctttgacacaggtcgtcatcaacgcgaaacgcgtcaaatcggacaacggcaagctctctttcgacgacgtggagatcacgatgggagaccaggaccgtctgccaccacaattgaccgccatgcagaagagcctcaccgtcgattccgacatgctcgccgtggatgactcgggcggcgtgtggaacagcggcggcacctcgaccgtcagcgacacggaccgcgccaacgtcgcgcaatggctcgaatcgcacgacctgcgcatggtcccggagactgtgacgttcaacagcactcgactcgacccggcacgcctcccgtggctgtacaaggcaagcccatccggcccgttcatcatcgtcaaggccaaggcgtcggccctgaccggttcagacggccgaccggccttcaccggccccgtcacgaccatcggcgggacgctctcataccggtggcgcaacggcaaaccgacgctcatccaggaagcgacgctggccgcgctccggccgctgctgacgaaaccactcacatgggccgacctgccatccatcagctggcagcagctcgacctgcacatctgcgacctctcgatgatccagatcatcgacacttcttcgaccatcgacgaaaaggaaggaacacaatgacagcaacaacacccatctacgggctctcatatccggaaggctccgacctcgtatcaaccgcgtcggcctcgttcaaaagcatggccaccacttttgaaaaagcgctcgatgaagtggacaaacgcagctcgcccgaaggcgtcaaacctgtggtggccacggatctcgaaacactcgtcaagaccaacggagtgcaggggcaatccggcatcgtcaccaacgccgggcagtcgcagggtctctactacctgttcggcgaccgctgggtcccggtcgaggcgcgagcgaaacgccgatggtacgggaatttcacccgatcggacggccagctacagatcaaccccagcggcgacaccggactgaccatcaccaagaaatcgggtagcgacgacatcacggtatccaataacgcgaagggctcgtacctgcgtctgccggcgggactgtggctggtcaaggcacagctgcagttctccggtatccatgaccagacatgggtccggatgctcatgacgacgattaacggggcgtccaatctgatgccatcgatcagcgagaaatccaccagcggcaacgcgtacgacggcatcagcgtgttgaccgtagtcgcctcggacggcgaaagcggagctgtacagccgatcctcggatccaacgcggccggcatcatgcgactgcccggagaaatcggcgtcatcgaactctaggaagaaaggaaggaagaaatcatggataggaccgaaatcgccgcgctggtcatcacctgcgtgctgatcgtcatggactatctgacaggtctggctaagtccatcgtgaacaaggacatcgacagtaccaagatgcgcgacggactgtggcacaaggcagcgtacgtggccgtcatcgtactcgccgagatcatcgagcacggacaggaggccgtggacctgggattcgcggtgcctctgatcgtgcccacatgcgtgtacatcgtgctgaccgaaaccgcatcaatcctggagaacctcagtcagatcaacccggagctagccgtctcgcccgtcatgcagctgttccgtagcaccaaggacacgaccaggaacggcgcgaaaagcggcaagggggccgagtgatggagggaatcatctggaaaggctcgcccaaccactacaacggcaggaacggctacagcgtgacacacatcaccctgcacatcatggtcggctacctcgccggcaccgattccacgttcgccgtcaccgccagccaagcctcagctcactacggcatcggcgcggacggcaccatccaccaatacgtttcagaacgagacggcagttactcggacgcgaactatacgagcaacaacagctgcatcagtatcgagcacgagggcggcatggcccagggcgcggtctgcacccaggcatgcatcgacgccagcgcacgcctgtgcgcggacatcgcccaccgctacggctgggaccacctgtggcacgacggcaccaggggcaacatatggctgcaccgggagatacccggcacggaccacgccggatgccccgacctcgcgcccaacggcctgccctaccagcaggtcatcgacaaggcaaacgccatactgaaaggagaaaacatgtcagtcgcagaagtcaccgagggactctaccaggccaagggcaacgacggacgcaacattttcgattcggtcatccagaccaggaacgagctcaaggaccgcaccgccgacgccctctacacagccaagggcaacgacgggaggaacctgttcgacggggtaatccaggcacgctgggacatcgccgaactcaagaccatgctcaccgcgcagaccgccgcgatcgaagcgctcagccaagccatgggcgccgaccccgaccagatcgcggaagctgtcaagcacgccgtagccgacaagctcgacagcttgcacatcaccatcaaagccgaggattagcctgcaatccggacggccgccgtggcttctctcagacggccgtccggcattgcaacgtaatgctccgtggtctcgaccgactcatgccccaacagttccgcgaccacgaacaggtcgtgtgtggcggcgtaggccgtggtggcgaaccggtggcgcagcgtgtgcgcggcgtatccgtccggcagcagatgactgatgtggtcaccgatataggactcttccacatgtccgccgaaccggccgggaaacaggtatccgttcgcgtccatgacgatggcggccagatcgtccggcaacggcacgatacgttgtttatcgcctttgccacgcacgataagcgaatggccggcactgtcagccacgacgtcatcgctatggacacgggcaatctctccgcgccgcagcccgcactcggctccgaaccggatcatgagcttttccgctgccgtggccttctccatcgcagccgtgatgtatttgtccgggcatggccggggatgcgcgtgtggcttcttcacgcgtggcacatccagactcgggtcgtcgcttctcctgcagcttttgtgcagccaacggaaaaacgacgaaatggtgttccggtacgccttgcgggtctccggtttccattgttgtcgcgcaaagacctgcacaatctgctccgtggtcacgtcttcgggacctgatggcatgaacagcgccgcgagatgcaccatcttgtatcgacggcttttgattgtctgtgctgataggccggccgccctaagggtgtcagtccacccttcgatgcttttgcgccatgggaccggtgcgctgatcttgttcctcatgatccatcatgggcatcctgatcttcacgcggctaaactgagcttggataagctcagaagcctcatggatttgaaccttggacctctggtatccccagaggtcc

SEQ ID NO: 84 - DNA, 38530 bp, Bifidobacterium pseudocatenulatum
cccgattgcagcggaacgcacgatagccggaaatacggcatttcagcgattggttggctcagccccgatcagtcgcggcggcgaatggcaaagatgcgggcggagggttgcttggaggtggcggcgttcaggcgaaccgtttccggatccatgcgttcgatagtccacggtttggcattgggcgcatggtccggttcggcaggattcggaaacacctgttcaatggtttgatccgcatccaacggcatgttcacggacggtgtgccgccgcgacgccacacgatgatgtagtcgggcttatcttccggctgaggttgctgatcgttctgctcggcagcctgctcattccaagcggattcgccgtacgcatacgcgtcacgcatatccgtttcgacatgacgcaagccgacggcaagccaatcgccgtcgaagtcgggaagtccggacggccagaacggcaccatatgctgctggtcggcaagtacacaacgatgtaaggcgatagcgtcgcgaacgagcgaaagacgcggctccgtcatgcgatcgatgaaaccagacagatacagcctgccgagcacacccgtagcaagcgtgaacacagcagtctcatcatccatctcttgctgagcgtaaccccaattaccctgctgttccggcagaatcgtcatacctgcaccagccgcaatcgcagcataaatcagaggatcgcactggtcggaagtggactgcaaatccaagcgggacaactgcgcgtaatcggcgcgcatggcaccggaaccgcagttttcgatcatcacatccggatgacggcgacgcagatcgtcaagccaatccacatatgcgcggcaatgctcgagcaggccatcgccaacggactcggcattcaaatcagtgccgacgccgggaatggtgttgtagtcgaacttgaagaacaccgcaccgaaatcgtcaatcaaacgatcaacagtacgcgtaacatgctctcgcgcttcgggagaacggaaatcaagcagataacgacccgaatcgcacacgcgaacaccatggcgctggaagaacgcggaatccggcaacatgctcgcaagcggcgatttcacgccgatcacttcaggttcgagccacagtcccaagcccatgccatgagcacgaatcgtgtcggcaagaccgcgcagaccggcgtcgccgaaacggttggtggaggcctgccattcgccgaccatgtcccaccagccgccgtcggtgctgtcgtaccagccggcgtcaatgcagaaaacatccgcgccaacgcttgccgcaccttcaatcagcggcagttccttctcaatacgagggtcaccgaacagcgtattcatgtaatcgttgtagatcacaagaccctgcgtatgctcgaactgatcgacgcgccccaactcacgagccttggcaatgcgcagcgcacgacgctgcaacgtcatttcggcaacagcctgctgccaatcgcctgcggcaatggcaaacgacacaggaacggactcgaaatcattgccttcaccaagattggtgaaccaaccatgatccttatattccggaccgaacgcagtgacgtgcagaccgggatcgtcctcgccgacttcccactcccacggaccgttatgctcgatctgccacattacggaaaaatcgcgggcgcggcgtaccgaaccttccacctgcagaatgccggccggctcatgctctcccgagctccatgtagaagtcgagctcatggcaaaacgcgaactagactgaccaggattgattttctggttgcggttacgcacctgagtgtcacgcagcggacgaacacgccaatcgttttccacagcccaagcggcatcgccccagaaaatattcgaacgatgcaccttgccgcagttgacgcgcatcggaacggtcagattcaacgatgacaccgcttcaatcggcagttgcctggcggactgcagacgcgtgtaggtgcgcactgcggaaagattcgggaacgcctcgaatacggaagtgaccaccaagcctgcattggaatcggcggaaaccgcctcggacgcggaattcgcggcggaatcggctgcgtcacgttcgcttgccgtcggctcgaattcacgacctttcggttcaagatcggcatacggcgcgaactgcgtgatctccaaacggaacggatcggcggaacctggttcaggttcggaagcaagcgcggaaacgaatcgcaattggctgccggcaactgtggcaatcagcgtcagtcggttgtcttgcgaaccggtattggcggcacacacctcaacaatcggacgcggatccttttcaaccactggctttccatcgtcagacaagcgaccatcgatcggaaccatgttgcgccctacaacgttgcagaggcgaacgggggaatcggcggcaatgtcaaacagcatggagaccacaccattgccccattcaaggcgcccatcctgccgaggaacaaggggagtcatattgccgttctccattgccatctccttcgaattccgaatgccgcctatccgttgacgtgcatcgttcgacgtaccctcactagcttaagcggaaaacggggcaaccgcgatatgcgtgtctacgcacattcagcaaatattcagcaactgaaatgaccgttcgaagaccagcaaatacctactcgaattgcagatattccacgaattgaatcggcatatccttggattccgtgatattgctgaatccgagaataaccccttctttcggcagtcccttcatggaagtccatattttcgaatgggacaagtcgaatccgacagcgtcgttcacatcggaaaccggattgcctttggcgtcgaccagcgcatccttgacctgctcaagatcggcggcactcatcacttccgcgggtttggtgatgtcgccgcgatcattgacttcggcgaaaatatcggtttcggcaacaatcatgttgatctgacctgccgaaacgcgagccgtcaacgatgcggaaccatcttgcgcggcattctcgctaatcgcaatggaggcatccgtccgcacgagacgctcgtcttcaataccttgcgtcttcacaaaatcagcgcccaacgcatcaatctgttcggaatattccgccatatcgacaccttcaagactcagctcggcctcgggacctttggtcacatacgagatgacgaaagcaagtaccaagccgaccactgcgataatgatcagcacatcggtcagaaagttctgcttgaagtacggccacttgtctttcggcggcagttcgcgaaaggttttgaatttcgattgcttcgcatacacgttggtggatgcgagcgctgcgaccgcatcttgctgctcctgggtgagaactggcttctctactgccataccaaaccttcccgcgttgtttcatcgacgcattcacgcgtcatcttcatgcgcagcaacatgcgttgctttctgacttccctatcttccgcctcgtacctgataatttgcggctagccgccggccgaaaaacgacaagcggctagcaggaaggctgatttcaagccaatcagtccaagccctaatcagcccatttagaccttgatcatggcgtattgggagtcgtagaggcgatagtaggcgccacgcttggcgagcagctcggcgtggttgccttgctccatgatctgcccatgatcgatgtagcagatcatgtccgcgttctcgatggtggacagtcggtgcgcgatgatgaagctcgtgcgtcccttcagcaggtggttcaatccggcctgaagtgcctcttcggtacgcgtatcgatattcgacgtggcctcgtcgagaatcagaatgcgcggatcggccagcagcacgcgggcgaatgcaatcagctgacgttgaccagcggaaagcgtggaaccgcgctcctccaccaccgtgtcgtatccgttcggcaaatccataatgaactcgtgcgcatgcaccgccttcgcggccgcttcgatctcagcatcggtcgcatccaacttgccgtaacggatgttctcgcgcacattgccggagaaaatgaacgtatcctgcagcatgacgcccatctgccgacgcaacgattccaatgtgaccgaacgcacatcatgaccatcaattgtgaccgaaccttctgcaacgtcgtaaaaacgcgacagcagattgataatcgtggttttgccggcaccggtcggaccaaccaacgcaacggtgctgcctggctcaacatgcagatcaaccagattgagaatattgcgaccgtcaggctcgtaacggaaaactacatcgttgaaatcgacgcgtccttcaatttgcggcagttcagtcgcgtcaggcgcgttacgaatctccggctgcacgtcaagcgtttcgaaaatacgctcaagatatgcggaacaagtgatcagctgattgtagaaattgccgatgctgatcaccggattccagaaattattcgcatagccaacgaacgcgatcagcacgccggtggaaacgttcaccgcgccgaagcccgtgacgcccacatagtagatgaatgcgatcgtcatgacggaaatggtttgaatgcccggccacatgaggaactggatatgcacggccttcatccacgaggtgcgcacgtcgtcttgctgctcttggaaggttttgaactgcgccgcctcctgggcgaaggtctgcgtggttttcacgccggtgatcgactcgtgaatgaacgcgttgagattgctctgcttgttcgacaacacctgatacgcgcggcgctggaaatgctgcaataccagcacccacgcgatcaggaacgggaagagcaccaggctgaacagcgcaagccgccaatcgaccacgaacatgaccaccagcgtgatcaggaaggtgaacacgtcggaaatcacattgatcaggccggaactcaacgtgtcggaaagcgtgttcacataattgaccacgcgaatcaggattttgccgtgcggacgcgaatcgaaatagctgaacggcagcgtctgaatatgcgtgaaaatatcgcggcgcatgtctttcaacatgagctgaccgacgcgagtaatttcgacggtacgataacgcaatccaaactcatacatcacaataagtacggccatcaaccccgttaattcaccaagtaaggtgagatttttcgacggaatcgcgctgtcaatcatgattttcgtcaaatatggcacgactaccgcaatgcagctcatcatgacgacgacggcaagaatgcgtatgattcgcgacatatacggctttacatagacgccgatgcgcagaatatcatgcaggttgatctgttcttccagctcttcatcttcgcggtatgtgttacgttttgccatgggttttcccccttttcctgccttcccgcgcctacgcttcgaaaccttgcgaacgacccgcctgcaagccgagctgcctgtagtagatctcccaatatcggccgtgcgcggccaccagttcgtcatgcgtgccgcgctccacaatgcggccatgctcaagcacgaggatcagatcggaatctttcaccgatgaaatacggtgtgcgatggtgacgatggttttctgttcgtccagttcgcgcagatggcgctggatttccgcttccgtttccatgtcgacggcgctggtcgtatcgtccatgatgaggatcgacggattgtcggcgagcgcgcgtgcgaggctcaggcgctgtttttggccgccggaaaggccgacgccacgctctccgaccacggtatcgtagccttccggcatgctgcggatgaagccgtccgcgccggcgatggtggccatgcggcgaatgtactgttcgtcgtattcgcgttgttcgcccgcgccgaagctgatgttgccgccgatggtgtcggagaacaggaacgtgtcttgcgccacgacgcacacttgcgagcgcagtgtggcgagcggccagtctcgcgcgtcgacgccgtcgatgagcacatggccttcggtggggtcgtagaagcgggagatgaggttgacgagggtggatttgcccgcgccggtttcgccgagaatgccgagtttggcgcctgccggaacatggaaatccacatcttcgagcacgggggtgtccggttcgtcggggaaggcgaagctgacatgctggaagtcgatgctgcctgcgatgcgggttgtgttggttgttgcagcggttgcagccgctgtgctggcgtgattcgcgtcggcgctgtctcccggtttttccgtattttccggcttttccgtaatacgtgactgagcggtgagcagtttgcggattttgatgcaggatgcgttgaatcgctgccagtcgttgatcagccatccggattggcgtaccggcccgtcgatcatccacaggtaggagttgaacgccacgagattgccgagggtcatgcgcccggtgatgaccaggaatccgccgaatccaagcgtgatcagctgcagtgagaagccgagaccgtcgagccatggcatgtatttgcggctgttgtaggcctggtccatgttgcgttgcatgtaatcgtcgttgtgtttgtcgaatttttcggtttcatacggttcgcgcacgaacgctttgaccacgcggttgccttcgatgttttcttcgaccattgagttcatttcggcaagcgagttgcggatggcgaagaacagtggtcttgcgtgcgtggagagtccgcgcgtaaggatgaaaatgaacggcgtgacgcatgcgagcgcgagcgcgagccgccagtcgatggtgaacatcatggcgagcgcgccaatgaacatgaccacgcagtcaagcacctggtagctcacccagctcagcgcgtggcgtatggcatcggtgtcggaggtcatgcggctcatgatgtcgccggtacgcgtgtggttgaaataggtgaagtcgagttcgtgcagtttctcgtattcgtcgctgacgagacggaatacggagttctgcccgaagcgttccatccacatttggtagccgtagcgcgaggcgacgcgcacgatggtgaacacaatcatcatgatgcacagtcgcgtcagttcgtcgacttggccttgcacgatgacacggtccacgatgaggcctgacaatagcggaatgatgagcgccatggtgttgttgacgcagaacagcactatcgcgccggccactcgtggcaggtcgggtttgcagtatggcaggatccatttaaggttgcctgcttctgtattacgattcggatcgacgtacatacgtagcgttccttcggattgtttgctggttgtctgggttttcgtgggttggttttgcgtttttgcgttgcttttacggccattcgttgccgttacgattcacgtccgtcgtttgtcgagcgtcccgttgccgtctctctcggtcgaaacccctgttcggattcgcaaacgcgacttattctatgcgaaccgttttttgatgcaacgtgagtgatttcggcgtgtcgcaatcgcaataaaatcaacgcatgtaccgttacataaattcgctctggacgtaaaggaatacgggtgatcgcagtagcgctttctatatcgaaccggtacgatatatcgaggtgcggcattccgatgacggaacggccgcaatcgcatgaacatcatgaaaggacggcgttgatgacgagcacacagaccattgaggaactcagcgcacaatgcgcggcaaaatatggcatcacccgtgagatgatcgaccatgcggaacgttggacggaaaccgacggcgatctcgaaggcctttccgaagagcgcgtccgcggcattctcgacatgcgtttcggcgcgatcgcggttgacaccccgcgttccgaactgtggcacacacctgacacaatcgacgtgatcgaagatattccatacctgcctgacggtggctacgatacggaagccgggcagtgcagaggacatttgctcgacctgtatctaccgcacgatgcggtgctgcgctgcgggcatacgctgccggtgtacatcgatatacacggcggcggtttcacttacggatataaggaattgaaccgcaacttcaacgtgcatctggccgaaacgggcttcgccgtattctcactgaactaccgaccggccccgcaaaccgatttgaggggtcagctggcggacgttcaggcggcattgcgttggatcaaggcgcatttgactgattatccggttaatccgaacgccgtgttcctcaccggcgattcggcaggcggcgcgttgaccatgctgacgttggcgattgaaaacaatgccgaagccgcggccgcattcggcgtggatgagccttcgggcattggtttcgccggtgccgctccggtgtgcggtgcctacagttccgcatcgttggaaaccatgggaagcgaactgaccgtaggctacgatccgaatcgccgcaccggactcgaacagatgctgggcgtcgaattcttcgacggcatcgaagccgccgacccgaagttcctcaccgccgaaggcctggcgttcaacgtcaacctgccgccactgttcatcgtgacctgcggcgacgatttcctcgaggccgacaatctggcgcttgctgccgcactggcccgcaagggagccgatttcgaactgttcgacccgaagccacgccgccacgaaacgctcggccacgtgttcgtgatcggcatgccatggcttgacgaaagcgtggaatgcttcgaacgcctgcgcaggttctcgtacgagcgctgctgaatcacgaatgcctgcacgcgaccacgcataatcaccagcatcacaaacggccgaccatgcattactcacgcatggtcggccgtttgtcttgcaactcttttcggcaaaatcgcgaaacataaatcgcgaatcgcacgaatcgcatgaatcgtgttcagaaaagaagaaagccggcggaaagaagggccgccggctgagagagaagagagaagaagggttcagttatggggttcttcaggaacctcgccagccgccgtaactgctgacatgttctatataagcgcccgagtcttggaggaatgatacgtgttcctgccaattagctgagaaaaatgtatcagacatgtgagcggccatacacattcgtgaattccgtcgaatgatcgcaacattacttccgatttgcccaatcgcacgtctatatcactcacccactccgcaaaaatcatccatttcactggacgattctgaaaaaacgcaaaatcatccatttcaccggacgatatgtcgagctcaagatgctgccgttgtctttctcggaataccgaaatgcattgcaaccgacagcaaatgacaatgcgctgttcgaccggtatctcacatatggaggtctcctctacgtcacacagctcaccttggataccatcgggctcggcgactaccaagacattcgacaccgcaacatcctcgactggctgctcgagtaggacacactctcccgactgcacaatttgcgtccacggatcacaaggtacgaaaaatagcgggaccaaatagttcctgcataacgtgcgccgtgttccacctatgatggatatatgaaatatttcgaatatgaaatttccggcatcgacggcagcgcagcgaaattcgtcggatattgccttgataacagcgaagaagtcgttcccgaccgtgtgcgtccgtctgtgcttgtgattccgggcggcggttacgaaatgacgtcggatcgtgaggcggagccgattgcgatgcaatttcttgcggccggtttcaacgcttttgtgctgcgatattcggtgaagccttccgtttttccagttgcgctgttggaagctgccgatgcgatgacgatgattcgtgagcatgccgccgagtggcatgtcgatccggatgcgattgccgtgattggcttttccgcaggcggtcatcttgctgcgaatctcgccacctccaccagcgacgatgttcttgtcgctcatggttacgatccggatgcggtgcgtccgaatggtttgatgctcgcctatccggtgatcacgtctggcccgctcgcccatcgcggcagtttcgattcgctgcttggtgaacgccgcaacgattcacaagcacttgaatccgtgtcgatcgaacgtcatatcgacgccaaaacaccgccggttttcgcatggcataccgttcccgacgaaaccgtgccatacgaaaacacactgatgctgatcgacgcttgcaagaaagccggagtcagcatcgaagcgcacctattcccgcaaggcgggcatggactgtcgttgggcactgcggaaaccgcatggcagggcgtcaacggcattgaaccgagtatccagatctggccgcagctggctgtctcttggatgcgcagaacgttcgcacgataatcagcgcagcagacgccgtgacatctaaccccatctagtcacgtttcccgcctgcgcaacccgcaccctgcatctgcacaacccataaaatcgggttaaaacccgggttgtgcagacgcagaacgcaagtcgcgcagacagcacaacacccccgaaccgaccggataggccgaaaatcataagcttgagggcaaaaatcagcggggctgacggaagcgacgatcgccaatcggatcgaacggtgtatgcggctcgagctgataccagtacgcgacggaagcgacgtcgtcctgacgctcgaaattgccgccctcctcagtaccgatctgctgccattccacacgcaaatcatgttcgaaataaatcggatcgggaatgtgccagcgatacaatccgcgggtcaccggcgtattcacatcccaatacgcgctctcgcgatgcgaggcgagacgctgcgaatagaacgggaaaccgacgtacggcgcacagaacgtctgctcatgcatacgcccatgctcgtcgaaatcggcgaaactccacgcgccaccgaaataatcctcggcaccggtgctgcaccacgtgggatactggtcgtccccatcgatgtacatcttgacttcaccctcgccccaccagcggctttccaacgcggtgagcgccagatacgtgccgatatacgcgccacgaccatgcacgccgtcgagcaccacatagtcgcgggccagttcggtgacgcgctcgcgacgccactgcgcatgaaaacgcatggtgccggccggaagcgcatcgtattcggtgtagtcgatctggtagaagaacgcgggaacgtcttcgttgtgatcgttgcggagcacgatgcgcgcatgttcgaacggcatggagaagtagcagttgaagccgcgattgggtacgaccaccaccggcatcgaattgactcggcaggcctgcgcgtggccgcagcagaagaagtcaccgaccgggcattgcacggacggggtttcctcgccatcccaatagaattccaggatcaggttacgaagcacgttcggaccggtagacgacgtgcggtcggtgacggtcatccaaatatgacggatcatgcccggaccgtccacatccatcaaagtgacgctctcccccgctttcacggtctggatgcacggactgcccttgcgcgacgggccaagtgcactggctgcagtggccgcagcgcccttgccgcccgtgggattctcggcgttcacgcaacgtgtgcgccctggtgccgcaaccgcaagcaagtccagcggactgcgcgcggcgaacgcacccaacgaatcaacctgcatatcgtgacgtgagctgttttgcatggtgctccaatcgttatctcgagtcataagaaaccccttttcccgctactttacggcaccagcggtaatgccctgcgacaacttgcgctggaaaataatgaagaaaataatagtcggcacaatgctcagcagcgaagccgaagcaagtgtggtcgcatccatcgtgcgttggccctgcaatgtggcgagcgccagcggaatggtctgcacgtcgtcgcccatcaggaatgccatcggaatcatgtattcgttccacgtccacacgaagaagaacacgaacagcacgctgatggtcggccaggaaatcggcagcaccaccttacgcagaatctgccagcgcgaggcgccgtcaatggctgccgcttcgagaatggcctgcgggaacgtaccgtatacggacgacagcagatacgtgccatacgcactttgaatgatggtgaagatgatgatgatcgccagtttggtgttgtacagtccgacctgcttgaacatggtgtacagcgggtagagcagcgcttcctgcggcatcatattggcaagcatgatggcgagcacaatccaagtgttgcctttgaccctgccgatgccgagcgcgaaggagttcagcacggaaagcacgacggcggccacagccactaccagcgaaataaccaagctgttccagaatttcagcgggaacttggtggtggtccagaaggagatgatgccgtccatggtgaaatgcttcggcagcgaaagcgggcctgttgcattgtaatcggcgggtgttttgaacgcgttgacggtgagcacgagcaacgggaaaagcacgagcagtgcggctgcgatgagcacgatgagggtgatccagtcgccggtcgagcgcacatgttgggttttcttggatgctttccgcgctgccgatgcggtcatggtttgcgtcatggttgtttcctcgactttcgaagtcttgcgagtcttgcgagtcttacatgttacgggtcagttgcggtttgaaccgttcagaccagttccttttcgacgtgcttctgcaccatggtgaacacgatggagaacacgatgatgaccacggtgagcgctgtggagatggccgcgccgtagccgacttgttgcacttggaagaattgattgtaggaatagtatgatggcacggtggttgccgttcccggcccgcctttggtgagcagatagaccggtgcgaaggttttcagcgcgccgatggtggcggtgaggatgaccaccagcagctcgggaatgatggacggcagcgtgaccacacggaatttctgccaccagttggctccgtcaagaccggccgcctcgtaaagttcaggatccacgcgctgcagaccggacatgaagatcacgatcggatagcccaactggatccacaccagaatgaacatcagcaccggaagcgcgctatcagggctgccgagccagttatgctgcaacgatcccaggccgagcttgacgagcagcgcgttcaccgcgccatcttccggacggaagatccagcccatgatgatggccgcgacagcaaccggcagcaactgcggcaggtagaacatggctcgcaggaaggaagccgtcttgccgccgaatttcttctgaataacgtcagtcagcagtgacgaaataaatagtccaagaatcgtaggaataactacgatagccacaataatccagaatgaattagcgaatgaaatccagaacgtggaatcagcgaacagacgtttccaattctgcaatccaacgaatttaaccgggccgactccacgccatcgagtgaaactcaagtaaatgttccacacgaatggaataacgacgataacgagcagacctaccagtccgggaacaagatatggtacgaattttgcggaacggtttccgggaagccttgacattgagactcccccgtttttggtcttctttgacattttggcttttcctttggttgcgctgcgttgcctgtgaatatttacgattgcgatattggttcgcaagttgtaatttgcgataccgcacgggattattcatgattgatactgagcaaaaccggaataatcccgtgcgatgtcggatatgagatcagatatacgatcagttggtcttgacgcccatgtcttccacaccgacgtcgtacttctcgtggatacccttgagcacgtcggccggcttcttggtgccgttcaccagttcctggaattccgccggaacagcatcggtaaggttggaagcggcgtaatccgggtagtagctgagcttgccatcattggcgtaggaggcgtattcctcgatcatggccttgctcttctcgtcgttgatcttgctggcgtcgcccgccaccggaattccgccggcgttgccgaggtagttctgcacatcgtcggaaagcacgtagtcaatgaacttcgcagcgagatccttgtggtgagagcgttccggaatcaccagcagattgcctgcgcagccaatcgcgaaattcgattccggcatcaccgcggcgtcccaatcgaaagtggtgatctgcttgacgaaacgtccctgattccaggtgccggtctgatagatcggatactcccccttgatgaatgcctgcgtggtgtcttcggccttcataccggtggcgttgtgggagatgaagcccttgtcgagccagtcgttgatggtgctcacggaattggtgagaatcttggagttccagtcgacatcgcccttgtagagctgccagttgtcgatgaatttggcgtcggcctccttggaaaccagctgccaccacagccacatcacgccgtattcctgcgcgtcggcggcgatcggcgtcactccggcatccacgaatttctggcagacgtccacgaactcgtcataggtggtcggaatctccagcccgtacttggcgaacagatccttgttgtagtagacgcgctggaattccgcgtaactggtcatgccgtaccaggtgtcaccatccatgatgccgttttcatcatacttggccacggccgcattggcgccggtcaccttcttgtcccaaccgtattgatcgacgtaatcacccaaatcggtgagcagccccatggtggagagcacgccggccgaaccgttgccgcgattggattccataagatccggcgcctcatcggaattgaggaattggctgccgttctgcgcgatctgcgtgaacgacttgcgttcgaaattgattttgacacccgtttccttttcgaaggcttccgcggcgcgacgccatgcctgggtctggccagcgtcgtcttcctcgtaataccagaacgacaggctgtctggcgtttcctcgtcttgcgcggtgtcgctgccgcatgcagcgagcgtggtcagcgacattgccgccgcggccgcaagtgcgatgcctcgtgtgatcttcatggttctcctttgttattggtggttgtgttgttgagttatgtctcaagttgttttttcagttatgaagattgatatgtgtcgcctccttttttcgaaacgtttcgacgatggccgcggattggcgcttttcaattcggcaatcaccatcttcgcttcggctacaacgccttcacccactttcgaatcgtttcgattatggatacggaaatccgtccgcctttcacggacatactcctacaaccttcttttcacacgtcaccaactttggtaacggaacctcgactatgcatgaccggagcggacagctccaccaatcccttgatgtcgcgatgctcatcgatggcgtcgaccagcagatccacagccttagaacataattcctgcggcatgaccggcatctcggtaatcggctgcggcatcagctctccctcgaaatacgtgccgcacgacaataccgaaatatcatctggcacccgcaatcccgaagcctgtaattgctgcaataccaacttcagcacattggcgttcgcctggttgacaatcgccgtggggcgctcatccaaagaacgaagctcacgcacgaattccgcggcatcaaagcgatcgtcacgatgcttggaggattcatgaatcgtcatgcccaactcttcggcacgttccagcaaagccttgcggaacagcagcacatagcccgaaccgcgatcgtaatcggtctcattgtcacgcaaaaacatagcgctccgatgccccttggaatacaggcaatccacagccatacgaccagccgtggcaaaatcgatatcgacacaggcacagccttcatgctctgcagggtaaccgatggccacacagggtttggaatatgagccagcctgggcggtacgctcgtcatgttcctcaatgtcgagcagcaccacgccatcaaccaagttgctttgcgtcacgcgccgaatgtcggccaccgcgtcctcgccggtaagcaacagcacatcgtagccacggttctttgcctgccatgcggtctgcagaaagtaagcgttgtatttggcctgattgatatcaccgcgaatcggcgcgctgagcgcaaaaatatgattacgcataccacgcattttacgggcgctggcatccggagtatatccaagtcgttcaacggcggccatcaccttatcggtggttttggcggagatggaacgcttgccggaaagtacgtacgaaacggtgctgactgacacccccgcctcccgagccacatctttgatgcccgtcatcttccgcctccttcggctctccaagtcatttgcgttacacgtcatgcgtaccgcagctctcgtccatcgttcaacaaagccatccgccgagccttccggaatttcttccgcagaatcacgctcgtattttatcgaatcgtttcgtcgaaacgtttcactaatcgtaagccagcaactcagctttgtcaaacgtttcgacacacctacccgtcattcctcgaaatgatggacaccaggatgctgcgaccccgttccttcatatcatgattttgatgtaccgaccgttgcaatcttgagtcccgtcgcacgattgcgatttggtttcgaccttacgattttattttccgctttttcccaaatcgtgaggtcagcaagccaaaaacgtgcggccatcctccccaaacactaggacgtgcagacggaaacgcaagttgcataggaatggaggcatctacaaccgccgcccgtacacgtacacacgggctagagaagtctcaaggctacagcgggcgggactcgtagatcatttggcggtcgccgaagtagagggcgtcacgccaagaggccttcttgcgggccgcctcctgctgaggctccttgatcggcacgaagaaccaacggaccagaccaaccaccatgtcttgcacggaatgccagatgccgatatacgcggtcaacgcccagaacgtcacgatcgcattgaagccggcgaacaccgcgttgccccaattgtgcgaaagcgtatcggcgtagaacaccatgcacgagtaaatgatgatcacccacggcatcgtcacatacaatgccggagaagcggtacgattattgactttcggcgtacgcgcgaacggaatcttcgtgttcgtcatgccctgctgaatcgacttgagcgtgccggaaagattcaccgtcaacagcacgatgttgaagccgtaaatacggaaaatatcggaacgcttatacccgttgcgtttcaaatcgctcgacatggtggcaaaatacggcaacgaagcgaacaccacccacgggctcagcagccgctgatcgaacggatatgccaacaggaacatcaggccgaaactcgaccatgcgatggacgccatatagttcacgcgcaaagcccactcgcccagcttcacatcattgccctgctgatgccgcgcgtgcacaatacggaagaatttgccgatgatcagcagaccgccattcgcccaacgccgccgctgcaccaccaacgaaccgaaatcaggcggggtggcactatagctcaaccgctccggatagttgaccaaatgccagccgaaataacccaaatcgatgctggattcggtgtcttcgatcaccgtgcgatcctgaatatacgttttcaccgtgcgcgtgccctcagtcgacaccacgcagatatcgtcgagcgcggccttgcggatcaccgcgttcgcacctacccagaacgtggcgtcatagtaggtcatgccttggtgcagcatgtgctgaatgtcggtggtggcggccgcgatgcgttcgattcgcgtcggcgcgccacgatacgaggaatacggggtttggatcacggccacgcgctcattgccgggctgttccatctggtacaccaagcgcaggcagtagtcgcgcaacagcatggaatcggcgtccaacgtcagcacgtattcggaattgcgcatcacgaaatcgggagattccccctcgcgcacgtcacgcagaatcaccccgtccgacgtttccacgcgcttgagcgagtgccccatcaatccgatgaacgaattcagattcatggctttgttgccttcacgggaggtcgacgcatacagcttgcgttcgaacgaccatccttttgcggtgaaaatgcgtaccaaacgttcgtacagttgcagaatgcgattcgcgtcgacatgctgctgcagggtgatcgattcgttcaacgcctgttccgtcaaacgcaggtcgcgtgcaagaccgcgcaatacctggtcgcagaagaaatcgtcggtatgatcttcgaccagccatgtgtcggccttgtgctccaaccattgcgcggccgcacgatagtcttccgcacagcgtgcgaccacactacgccttgcgtccatctgatcggcgagcgccgcaacggtttcgtcgcgcgctttggtgaaacgttccgcaggtgccgccaattcggccaatactttcggcatgagttcgcggcttgctttgagaatcgctcgcgcttcatcatttttaggatgcggaggatcgtcgattaggagtacgactgcaaggtcgggaaattcctgcaacgccgccgaccagatcgttttttcgacgactttcggctgttccacgtacgaaggaatcagcactgtgattcccttatcgtagttgtgtgcgaaatggtcgtcgagcatcgcccgaggcacgcgttcatgccggatgaaacggtatagcgccccttgccgtgtggtcaagtagacgagcgcgctgaaaatcagcgtggtcacaatcgtcatgtacagcacgccttcaaccacgaaacgtaacgtgagtgaaggattgttgacgaacaacgacagaatcatcgtgatcatgtagatcagccatgaaacaaccgtgcagatgatggcaacgtaaccacgcacaacgcgcgttggcgaaggcttggcatgcatgatcgcaagcggttgcgtggaggtttcagcaccccactggtgcctgcggtcatcgccgtcaaaatcccctatttttgccaccatatacccctttgcattatcagcgctgcttcacctgcataaaccatacatcactgttggaatcgtcgtactagccacagactacactccctaactgtaagcgagatataagaaaaacagcgcacgagaggaaagcttaatcccccgtaaaatccccgcatatgcaccgaagcccagcgggacacagcctgctagacaccccaatgtccccatcggcattggtgacctgacgatttcgaaagggaatgatgaaacccctgtttccaggaagacgattttccttcctccgactgttcatagcgatactgtgcatcgcgctcgtcgcggccggcacatggtcgtggatcacgttcacgcgaacggcggctaagaaattgccggaaccctggttcggtggctatgtggacgtaaccgcgacaccctcatacgagtttgaatccaaagtgggcaacgtctaccggaatgtgtccctcggtttcgtcaccgccggcgacggctgccagcccagctggggcggctactacacgctcgacgaagcggcttccacgctcgatctcgacagccgtatcgcgcaaacctacaaaaccgatcgcacggtaaccgtcagcttcggaggccagaacggcaccgaactggccgccgcatgcactgacgtcgacgcgcttgccgacgcataccagcaggtgatcgaccgctatcatgtcacctcgctcgacttcgatatcgaaaactcgaatctcgacgggtacagcgaaaccgcaacccggcgagcgcaagccgtggcaaaactcatcgccaacgaaaaagccaaaaacaaagggaaagacgataccagtcacgatctgatcatcagtttgacgcttccagccgacgcgaaaggccttacaacgcaaggaatgcaaaccgtgaacgcgtttctggatgccggcgtgacgctatccaccgtgaatctcatgaccatggatttcaacgtggcgtccacgtcgatcacgcaatccacgctgatcaaaagttcgctgaacgcggcccacgcgcaatacaaaaccttgctgtacagtcgcggcaaactcttcagcgaccatcagatctgggagctgctgggagccaccgtgctcatcggccagaacgacaccaaaaacgagtatttcacgctcgacaatgcgcgcgaaatcaacacgttcgcgctggaaacaagcctgggccacttaagcatgtggtcgctgaatcgcgaccagcaatgcggcgaaaactatacgaacaccaacacgctcaaaacattctgcagcggcatgaaacagacggacggcgaattcgccaccaccttgggctcgggcttccgaggcacaccgggcacgctcgtcgatttcgacaatgcacgttggaattcctcgcagcaggcctaccccacgtgggaaccgggagtactgtacaagcaaggcgacaaggtgatctggaacggcaatatctacgaatcgttgggcaacaacgaaaacgagcagccggacagcgctgaggaaggcacgaacgcaccgtggcgcatcatcggaccggtgctataaacgcttgccgcagcgagacgcaaccacagacacaatacaaggcaagaacacaaggcagtcgctacttttcagtaaaagtggcacgcaacaggggaacgaaatcaggcaatcatgacatcgaagcaatcaaagcatcaggcagccaccggcagccagccaaaagacggcatcagaaaaccagccagactcaccattctggccatcatctatgcgttgtgcattgcggccgcaatcgcattccatgcacaggaaggcgtgcagcaacttatggaagaccctgcgcgcatctgcatatggtcgctgtgttttctgctgtgcctgatctaccacaaaaagcgttcgtcgtatcgcgttgccgccgaacacaccgtgctgccaccgttgaccgtcatactgctggtaaccggctattttcccgacgtggccatgttcctgatcatcgttaccatcatcacgtcgatcatcaccgcacgcagtctgaaaatcggcattcttcgcgccggaaccacgcttgcgccaatcccactgatcaaaatattatttgcgaacacttctcacgtactgtcaattatcatcagccagaattccgtcaatgctgcgattaatccttatcaattccagcattggttgctgccattactgattatgactgttgcagtgccgattattcgattgatttgtgatattgtaacgttcttttttgtacaaattccgattcgtaaagccatgcgcgagtattcgctgtctcacattcttgccatggctttggctgatttgatggcgattgtgtggattcctgaaattctggagttcgccaatattggctcggatactgccaccgtgctttccgtgttcatgctggcactgatcgcctactcgctgttgctgatgacggtcgatacgatgagccggctcacgcgatcccgaagtgcgttgaaatgcatagcgaatgtgagcgacgcgctgccgttgccgaatcaagtgccggaagagaccgtcgtaagacgcatcaatcgtggcctcacccgcatgcgctgtttcatcagcaatgcaaacaatcttgataaaagagggtattcctaccgctattccgcgcctatttccaccggctcgcgacagtattatctcgcgatggaacgcagtatttggaatcgtccgttcatgtcgaccgacgagacgatattgctcacctgcggcgaagtgcttaccgaatcgttacgcgtgaacaaggaagtgacgctgctacgcaccgaatcggaaacggatacgctgaccggcgcactcacgtatcgtgcgttcatcggacatttgaagagtctgcagaccgagaatgtgcataatctggttgccgtggtgtatttcggcgtggagcatttgcgcaccgtcaacgaacattatggacgcaaaatcggcaatgccgtgctgcgatccgtgggcatgcgtttaagccagctgctgccgggaaacgccacgctttcgcgcgtgaacggcgcggaattcgccatgatcgtaaccgatgtgacgtcaaccagcgatgtggaggagttggccacgcgcatgcgcaatcttgccgtcatgccggtatacaccgaagaaggcgaggtttccgtggacgtatcgagcagcatttcgttctcgaacgcgacagacggcttctccgtgctcctcgccgatgcgagcgcgcacatctacgagtcggagagctccaatctgcccgtagtcgacggcatgacgtccacgctcgccgcgcagaatggttcgggagactatttcaacgcttccgacgtgcttcgccatgcgatcgaagacaatacgatttccgtgctctaccagccgattttcgatgtaaatacgaaacgtatcacttcgctggatacgattgtgcgcgtgcatgacgcgaagggccgtacgctggcaccgtatttcgtaacggctgaagcgcatcgtctcaacatgagcgtgcagctgacgctcgacgtgctggaaacctgcgtgaaagacatgaccgcattccgcaaggtggcacccgaattggatattgtggacatttgcatgaatggttcggaattaggcacgtccatcttccacgagcgcttggagcagttgactcatgagcagccacagctgcgtttcggcctgcagttgggatcgcatgccattcatgtggtgcatgatgaagttgatgatgaggttgccgctcttgccgctttgccgaacgtcgagttgggtttgaccaatgctggcaccacgtattcggaggttgccgcgttcgcgcatctgccattggatttcgcacgattcgacaagacggtggttcgcgatttccgtacgcctcgcgcaaagcagatcatgcagcgcacgctcgagatttcgcgcgataacgatgcgttccatgtggtgttcgatggcgtggagtccctggaccaggttgagttcatccgttccatcggaggcacgctcgccgagggcacgctgttgagcaacgccatgagcgccaacgagttcctcatgcgcctcgaaaccatgggcacttcattgcccgaagccaccccgaggcaagctgagtaaagaggagtctcgtttgtcgcacgattgcttcatctcgtgaaacgcttggaggaaatatggcgagatgggagcatgtgtgctaaattaattagtaaacgtgtttagccaacgatggctttgaggaggattcacatggccactatcagagagatagcgaaacgggtaggtttctcccaagccactgtttccagggttttgaaggacgatcccactttttcggtgaaggattccacccgcgagaagattctaaacgccagtctggaaatgggatacaagaacgtaccgcaataccagcgcatcaccattccgcaggatgttgcgattctcgacaatgtcgtacccgacaagggcttgcaggacgcgtatttcgacgagctgcgcgaagtgctcgtcaagcatgccgaagagcagcgtatgaacgtgaccatgcacgaggacgtggattcgctgatcgccgatgccgataaatacgcgggatttatttcgatcggcccgtccccactaaatcacaagacgcttcaccgcttgcataagaagctcccccacggcgtattcatcgacatcaatcctgcgccggcattgttcgattcggtacagccggatttggaacaaaccatattggatgcgatcgacgcgcttatggggtcgggttgctctcggatcggcttcattggcggcttgggcaacattatgggcaagcatgaatatccggaagatattcgtacgttcgcattccgcaattgggcgttgcgcttgggattggatgcgcaagggttggtgtatgcggacggcccgttcactgtggaaaacggccgtttgcaggggcgtcagttggtgcaggatcatgcggacgatctgcccgacgcggtaatcgtcgcagccgatccgttggcggttggcgtgctgcaggcatttgccaccgaaaatgtgatggtgccgcgagatatcaaagtgatcagcatcaacaatcaggagatcgcaaaatacacgtctcccgcattgtcgtcgtacgacattagccaggacgagcttgcgaaagccgcggtgcttatgcttgccgaagcgctgaccgccgaccgcaaaatcagccagcatatgcgaatctccaccagtctcgtcgcacgcgacagcttcaccccgcaagactaaatataaaaacttgagatacggcaagggccggcatcctattgcggagccggccctgcaattgtgcttcagtaatctcaccttagcggagagggcgagcgtcacaccagacgtgggtgacggaccaggtggcgggatcgagcagaagcacgtcggcagcgtagccgggagcaagcagaccgagaggttgcttggtgaccgggttcgcgcggtcgaaaccgaatgctttggccggagtcaacgtggcggcctccaccgcgtcggcgggcgtgaatcccaattcgagcaccgcacgctgaacagccttttccaacgtcagcgtggaaccggcaatcgcaccattcgacacgagccgagcgtgaccatcgatcacatccacatccaacgcacccagcagataatgaccgtccgggcagtcggtagcagccatggcatcagtcacgaatgccgtgcgatgcggtgcgaaaccaaatcccaaacgcaccatcggattctgcacatgaaaaccatcattgatcaactcgatagtgacgcgtggatcctcaacagcagccggaattggaccaggctcgcgatgatgcaagccattcatcgcattgaacatgtgcgtcataatgcccgcgcccgcgtcgaaacccttgcgagcggtcgcataatcggcatcgcaatgtcctaccgcaggaaccactccggccgccgcgaagcgacgaatcgcatcaatgccgtgcggcaattcgggggcgatggtgatctgacgcagacagccgcctgccgcttgcaaaagccgatcaacatattcgggaaccggatccttcaaacattccggatcatgcgcacccttgcgagacagcgcaaggaacggtccttccagatgcgcgccgagaatgtcagggcgggcgctcatcatgccgtgcacggtttcgagattggcgcacatcacgtcaagcggattggtgatcaaactgagcacttggcgggtggtgccgtgcatcatgtgacccgcgcgagccaaacgtatgccctgcacgccatcatcgaaggaactgccccacgaaccgtgcgcatgaatgtcgacataaccgggagtcatcatgcgacctgcagcgtcggttacggaaccggccgaaccggtcatggcattgccggaatcagccgaactgaccgaatcggaatcagtatcggcatccaaaccgacgcttgcgcaagccgcagcaaaatcagcgtcccgattcccagtcgcaataatcgcgctaccatcggaaaccagccaataatgttccgcaacacctcgcgcatcgactttgcgcgcattatgaatcgcaaacggacgggccgactgcgctaacgcaacgtccacctcattcgcaaaccgctcacgagactgttccatcttcataccttccaattcactcccagccatattcctcaattagcatccaattcttccattcagtggaagaattaccccgctgacaagcccatcagcaacccaatccttccagtcagtggagaaatcctcccgctaacagccacctcagagtcccaattcctccagtcagtggaggaatctggactgccaaacacccccgtactgcccaaaaccttccagcgagtggaggaatcctcccgctggaaggccgaaaaacgtccagaatgttccagcgagcggaagaatccggacgctagcggacaccgactgcggagcagcaatcagatgcgctgccaggcgggcttgtgggcgtaggcgtaacggtagtagtccttgtggcgtaggcggctcgcagcctcctcgtccacaatgatggtggcgtgcggatgcatttgcagcgcggacgccgggcagaacgcactcacaccgccctccaccgtttcggccacagcctcggccttgcccgaaccgaaggcaagcagcaccaagtggcgggctttgagaatcgtgccgataccctgcgtgatgcaatgcgtaggcaccttgtcgatgtcgtcgtcaaagaatcgggcgttatcgatgcgcgtctgctcaaccaacgttttgacgcgcgtgccggaagcaagcgacgatcccggctcattgaagcccacatgcccatccgtgccaatgcccagaatctgcacatctatgccaccggcctcttcgattgccttatcgtaggcagggccggcagccgcaatgcgttcgccgtcgctcagcggcgccccgtcgagcacgtcaccaggcacgtgcaccaaatcagggttcagtccaagcggttccacgaccgtgcggtgaatggtggaatgatatgactgcgggtgatcaagcggcaatcccaaatattcgtccaatgcgaaaccacgcacctgcgatacgtcaatatgctcgctgtgcacaatgcgtgcgagcgactggtatgcggcgagcggactggatccggttgccagtcccagcaccgcattcggcttggttttgatgagatcggcgactgaacggccgtaaatatcgcctgcttcgcgctcgtttttcacgatgatgacttcggtcatgatgttcctttcattggcattggattgacgtttttcgttttgctgatttcttgaggatttgtttgatgatttatttgctgattcggcgaagctcgtcggctgctttccacacggtttcctgaatgcgatgcagttccgacggttggcttgtcgcgttccattccttcgcataggcctcgcaccagcattcgagctcgcgcgccagcgcacgataatcggaaggccgccaatcgccagcgtcatgcgcatcacgcacgtcatgtgcttcggcgagcgcgaatcccactcgattgagcagcagctgcccttccatggcgatgcgtacggcagcagtaatgcccggatttcccatatgtgccgcaatcggcgcgatgtcgaccatgcattgttgcaatgcacgattggcttgcggaattcgttcgattgtcgttgccatattgcgcatcatgcgattgcgtgcttcacgcacagtcattgcgtttccacagtcagataaatgatcaaccaagcgatcggccaggcagggaatggtttgcgcaacatcggtattgcagtttcccgtgccgtcatccaattcgagatattccacaagctcacgccaagtgaatacggcttgcgcggaagcgttacgaagcaatgcaacgaatcgtgcgctgcaatcgccatattcgacgcgcgaaatacgctcaagcaaatcattttcggcagtatctccggcaggattccacgcatattgcgcaccgaatatcatgccgggcacggccatgcgcggatcgttgacatgcccaaaatcgccccaatcggtgacgagcatgccttccgcaccgcagtcgatgccgtagcgcgcgatgcgtgcgatgttgttccacgcatcgtcgatgcgcggcagcagcgcattccacccccatacggccgggcatacgatttgtttggctccggctttcgccacaagttggattttctcatcggtcgcttccggatcgtactgccagttcagcagggtgacattgttcggcagggtttcgagaatttccggcatttcgatggcgatatctccccagaacatgggttcgcggccctgcttagacaggtgttcgcagagtttgcccacgtatgttgcgtacagcgctgcgacgcccacgcgttgcgcttcctgcttcgacttgcctttgccgaggtcgaaggtttcgtcggcgcagatgttgaatcgcttcgaacggaaaagttgcagatacgagtcgaccagttgcgcagagaatgcgaaggctcgatcgtcggcgacgttgagcgtgtggtgcctcatgcgttcgatgaagctgaacggccggtctgcgtcttcggggaattcgccgagttcgcgcagttcctgcgtgcgcatcgccacatattggtgtccgaatgtggagactgacggcacgagttcgatgccaaggttcgcgcagtattggtcgaattcgagtgtgtctgccggcgtgagcgggcttgatccgcgccatgtttcgctcataccgtcgaatgcgaacgtatgctcgatgtacagctgcaattggttgtatttgtagaggcagagtttgtcggcccactgtttgagccatgcgagcgttggcacgcggccgcgcgtcgcgtccaaataatatcccctgatttggcatgcgggggcatctgcaatctgcagttccggcagtacggcaccgttttgccgtatgagttgacgcagggtctgcacgccgttgcgcacaccctcgaaatcgcaaccggtaatcgtaatgccgtcagtgttgatagtcagcgtgtatgcgccggcggtaccgccatcctgcgaatcgaaatcccgcgaatccgcaatacgcaatctgatgaagcccgaccacatatcgcccgtcgcaatatcccaatcagtgcctgtcgcggaacgtatgtcggcaacaagctgatgcgcaagcaggaaatcgccatcgccaatcgcaatggattcgttcacgcgccccgcatagggcaacagcaccgtgccttcgccgaccgtcatgctgttcggttcgggaatgatcgcccatttgcgggtgttctcgcttgccatcgattcgcctttcgattgtcgattatcgatttcaattctcgattgtgattctcggattgccgggattgccgggattgccggatctggatttccggaattgttgcgcttgttccagtctgcctgaagtatcacgcattcacgattgcggttgcgctcgttttgccgcgagcgccgcgccgattgcgccgattggttggtcaatggctgcgattctgatgttcgatgcgatgtcgagtgtggtcaggaatcggcatccttcggctctgcggctcagttcggcttggatgacttcgatgagtgcgtcaccggttttcgccatgcctccgccaatgatgatgcgttgcggatcgtaggcttgcgcgacgatttggatggtgtcgcccatggcgtgggccaccatggtgagcacgtcgttggcatgcccgtctccttgccgcgctttgcggatgagatcaggcatgggcgggtttgcggagggccaaagttttgccacggccccgccggatgccacggtttccaagcatccacgctgcccgcatgggcattcgaatccgttggggtcgatgggtaggtgcccgatttcgccgatggatccgctgtacccgtgttcggcttgcccgccgcgcacgagtcctgcggccagtcccgtgccgaagttgaggaatacgacggttgcgttgccgtcgacttgttccacgaattccgcggctccgaccgcagccgcgttcacatcgttttccacgtgcaccggagcgtgcatgattgcgctgacgcgttcgccaagttccaacgtttcaatatcaagattgacgacgttgctcacttgcccggtcgcgcagttcacctgccctggaatgccaatgccgatgggcagcgcttcgttggacagtatgcgggcgacgcgcacgatgtcggttacgacattgctttcaccggagtgcgatggcatacggcagacgtcgatgacgcggtctgttgcgtcgagcagcacgccttcgattttcgttccgccgatgtcgatgccgacgcatccttgcgaacggccgttatggtgcagtcttgcgttcattgcatgtacctgcctgaaatagtggggcccggattacggttgttctgttgatccaactccatgcgtggcgtttgcatgccacgcatggagttggatggatgcccgtcaacccttgaccgcgcctgccgcaagaccggcctgccagtagcgctgcaagccgaggaagagcacgatcaccggcagtacgccgagcagtgcgcccatcatcagcgatccacgatcgttgaaggttgcgagcgataccatgccatacaggccgagcgtgaccggcttgagggtgtcggaggaaaccatcatcaacggcagcaggaagttgttccacgttcctacgaagaggaacaggaagatggtcaccatggctggggcgagcagtcggagcacgatggtgaagaagattctcgcttcaccggcgccgtcgatgcgggccgcttccagcagttcgttcggtacggaggtttgcgcgtacacgcgtccgaggaagaagccgaatggcgaaacgcagcacgggatgatgatcgccagcatggtgttggtcaggtgcagtgcgtggaagatggagtactgcggaatggtgagcagtgcgaccggcatcagcatgcatcccatgaccacgccgatggcgatggccttgccacggaagttgaattttgcggtggcatagcctgccatcaccgaaatgatggtgccgatcagtgcggaaaccccggagtagatcagggaattcagcacccaacgccagaattggccacgggtccaccccataagcttcgaatagttggttgcgatggcgtcgggaatctggtcaagtccgacggcgaaccacaatccgttgctgctggtcagctgcgatggtgttttggtggatgcgatgatggcccaatagattgggaagaggaagtagatcagcgctacgacgagcacgatcacggtaatggttttggtgatcggcgatgggcgcatggagcgcggcagatcgtgttcggccgcttcgcgttgcttttccatcatgcgttccgcttttctgcgggcgcgttcgtcttttcttgctgcgactgcgttgctcattgttcgttcgccttcctctcgaccagtgcgtagatcatggcgagaacgcctgcgatcagtgccatgacgatggcgaccgccgatgcgggtccgtcaccgcccggagtcagcgtgccttgggaagtgttcatggccatcatcattggcgtataggttttggagatgcccggatcggcggtctgcatgatctgcggttcgttgaatagctggattgtgccgacgatggacagcaacatggacagcagcgccgcggaacgcacgttcggcagtttgatgcgcatggagatctgccatccacttgcgccatcaatgcgtgcggcttcgtacagttcgtgcggaatcgtctgcagtgctgccaagaaaatcagcatgttgtagccggtgaacgtccatgtggtgatgtttgccatggaagcgagcacaacgttcttgctgaagaaatcaacgtttattccgatggccgcaagacctttgacgatcggcgaaatctgaccgttatacaggtacacccaaatgatggatgcgaccacacctggaatggcgtacggcaggaagtagccgagacggaaacccgtgatgtgcttgaccacgaacgaatcgatgaccatcgccaaagccaacgcgatgatgatcatcagcggcacctgaatgagggtgtaaatcagcaccctgcccacaccggaccaaaaattgccggacgtaagcacgtactcgaaattctggaatcctacgaatttattcaccaattcgccgccgccgtacgcgccgccgccctcggtgacctgacggaagaagctggaatagatggcatagaaaatcgggatgatgaatacaatggcgaacagtatgccgaatggcgccatgaacgcccatcctgttcgattctcgcggcgttgcgcatcagtgcgctttggtttcgccgcttgcgttgttgcagtcatgatgtacctatctttcgcatcggatgccattcatcgttgatggcatctttcacagttcgaatcgccgtatccaaatcgtcatcacgggagaggagtgccggtttcagccgctccgtcgaatcagctagatcgattcatagggaatattcacaaggaatattttcataaggaacggtgtggagccgtgtgttgcgttggctccacaccgtcgttggaggggttatggaatcagagcgggtgatccctggttccatacgtcgatcacttcgctacggacaggccgtagttcttgagggtgtcgatggaggtctgctgtgccacagggaacacgtccgccaccttgccggaaccgtcggctgccttgtcggcggcttcctgcatagctgcggagaccgcggagtagcccggcatgtagttgaatgcgaccatgttgtcgttggcagtagcgaattccttcatcacgtcttggccgccgtagaattcgttccaggattcaggggtcttcgcggtttcggtgctggcggccacaatcagaccttgggaggtcagatcctcaacctgagtgttgaaccagtcgaggaattccatggcttcggccttgtgctcacaacccttgagcactgcgacgccggaaccaccgtcagggccggtgctggtgccattgccgaaccagtcaccgatctgggtgacacgccagtcacccttgccggtgtctcctgcggagtccttgaatagcggagcctcccaagcggcgccgatgttgccgatcagcgtgccatcctgcagggatgcgtcgaacgacggcacccaacgcgggttggtcagcgtggccttgttgtcgatcagttcctggaaggtttcagcaaaagcctgcgaaccgctgccgttggtgttgaccacccaagcgtcattcttgacggtgtaccacgggtcggaagcatttgccaaacctgcgaagatgttgccggcctcatcggcttcgtaatccatgatgtacttgccggacgcggccgcggtctttgccgcttcgatcagctcatccttggttttgggaaccttgatgcccagctcatcgaaagccttctggttgtagaagtacacaagcgggccggtatcttgcggcaggccgtaggtcttgccatcaacctgcatcatggaatatgggccttcggcgaagtcgcttttgtacttcgcggcctcttcggtcacgtcttcgagcaagcccttggtgaacacctcaggcacttcggcgtagccgacctgtgcaagatccggagcattgccggccttgacgtcggtttccagcttcttgatcatatcttgtgcggcaccatcgaacttggtggccttgacctgaatgttcggatgatccttgttccacttggcaacaatgtctttgaccaaggtcatgccttcggaatccggaagacggtgcatgtacgtgaggttgacgacctccccggaatccccgccggtgctggccgtattggaaccgcatcctgcaagacccatgcacagagccgcgaaagaagctgcgcaaaccatcaaacgctgagtgtgggatcgcatatctctctccttcgtgagattattccggcacctccttgcaccggatagtcacagcatacctacgtaatccttttttgtcaagtttccttacatttaaatccggcacgcgattgctattccacaaaaaagctgaaattccgccatttagtaacaatcgtaaagcaatcgcaattcgaggaaaaatgccgtatactcttgtttagtaatctttattgccaataaaaattacataacgcacttgtatcgccacaaactacaatatgtatcggctccacacaagaaagcgaggacatcgtgagcggtacccaagcaaaggcatcaccttccgacattcgaatcagcaatatcaccgccgcattcgagcagcttttccccgcaacgcaaatgtcgcgagccaatatcggcaaactcatcggactttcgcgcttcaccaccagcgaagcgaccggcgaaatggtcgacaatcgcattctgcgcgaactcggccccgacaatcgcgaagggcgcggtaaacgttcacaagtgctcgccatcgacaccgatttctggcgaatcgtctccgtcgacctgtcgaatccgatgctcgtcaaaggagcgctggcggatctttccggcagaatcgtggaccgcaccgagcttcccgtcgaccatggctgcagcgtcaatgacgtgatcgacctctgcaggcagctcatcagctcaacgccactgccgacccttggcatcggcatcgcggtgaccggcattgtggaacccaacggcgtggtgcgcaaatccgtgcacttggggtggagcgaactgccgctgaaaaccgaagtggaaaacgccaccggagtgcccgtgatcgtaggcaacgacaccaatgcggcacttgtggcggaacgattcttcggcgactgctcccccaattccatgctcatctccatcgggcggggcgtcggcgcggcattatgcctcaacgacgtcatcatcgaaggaagttccttcactgccggagaaatcgcacacgtggtggtcgacccgaacgggccaatctgcgaatgcggcaaacagggatgtctcgaatcattcgtttccggtgacaggttgcagcaacgcatctcgcaggatcccgccgcgcgtacgcatattctcaccgaagcgggcgcgttgctcgggcgcgtcatggccataccggcaggattgttggatctgcgcgacatttcggtatatggtgcgccggaaatcgtcaatactcaattcatcgacgcgatggaaaacgaaatcagccgcaccgtgaccacggattatcaggaggcgccgcaaattcaccgttgcaggcaaggcgaggatctcaccctgcgcggacaggccaccatcgtgatccgcacactggtaccgacgatccacgaacgcggctccctcatcggcgaagcatagctccggacgccttagcgcgacccaaaacctccagtcggtggaggaagctacccgctaacagacctgctaacgtccaaaaacctccagtcggtggaggaagctacccgctaacagacctgctaacgtccaaaaacctccagccaccggaagaatcgccccgtctgcaactctccaagcatccatattcctccagtcgctggaagaatccggaccgcaaaatacccccgtactgtccaaaaacctccagtgagcggaggaatcctcccgctgacaggccttttatcgtccagattgttccagtgagtggagaaacccggacgggatgagaggcatggagacgaaaagaatgaaaggccgcctgcagcggatggagtgcttcaggcggccctggttgtcggaaaggaaggggaatttcagttatcgggattcaggttggcccgccggagtcgcggttccagcagttccagcggtttcagccacggcaaccgcctcgacggcttccacggtctgagcgtcgtcggcttcgatctcaccgttggcgagcttcacttcgagctccttgacgatctcatcgtgcatcttctcagtgatcttcaccttgaacagaaacacgatcaggctcaggatgatgagcacgagcggaatgtagaaggcgcagatcttgaagatgtggatgttggatgcggtcatgtcggctgcggtcgcattgccggtcatgccagcggccacggcgatgatgccgacgatgccgttggacatggcgccaccgatcttgtcgagcatcgggcggacggacagggtgacggcctcgttgcgcttgccgttcttgagctggccgtattcgatggagtcggtcagcgacaggatggcggtcatctgaatgagggtacccggcacgtagaaaagcaccagagccacgaacaccatgatgatgttgtcggagaagatgccgagcatcacatagccggcgatcatggagatcatgccaccgatgtacaggtaacggcgcggaatgcgcttgttcaggatcgggtacagcggagccataaccaagcctgcgaccagtgcgatcacgccggtgagggagtatgcggcctggttgtcgaggatgaacttgaacaggaagatcagcacgccggtggtggccacgttggcgatggcgtacagcaggtagctcaaggcaacccacagcagctggtcgttctggaagatggccttgaaggcttcgatcgggttgccgttcttctgggccttggagcgcagggcgctctcgttctccttggtgccgaaggcaacggtccatgcggtcaagaggccgagcaggccgacgataataccgaagcaggtccagccggactggctttcgacgtacttgccggtgaacacccagctgaagtaggtgacgatcgggatgaccacgacggtgatgccgttgtagccgatggagccggtgaaggagccgagtgcggtgtaggtggagcgctcgtgggagtcggaactcaatgcagggatcataccccagtaggagatgtcacgcagggagtagaacacgtcgagcacgacgaaggtgatgacgaacagtacgatgaaccacgtggtgttcacgttcaccaagccgaacaggccggtgtacactagcacgatcagcacggacgaaatcgcgccggcgaggaactgccatgggcggaaacggccccacttggtggtggtgttgtcgatgatgttgcccagcagcgggtcgatgaagatctccgcgatacggatcaccacgaccaggccggtgatgatgccgatcagcttggtggcgacgcctttatcgacaccagcgaacaaggagctcgtcacatagacgacgaagtaggtgctcagtgcgttatagaacgcggactggccaaggttgccgcacgcgtacgctacgcgctggccgagctttccgcaacgagccgtgccgttcgcagtagtggtcgtattgctcattatctcttctccttagaagattttgatgagatcacccgttgacctcgaaaattgagtatacgttgtttactatcaaaagtaaaattccttagtaaacaaagcccccaaacggcgtgtcgcaatcgcagttcttacgattatcaaatactgacatctgcaatcatgattactaccgccatttgccgtcacctatcgccatataagtaaattcagttgcaaataaagcaacacgcagatttgcaatttaagtaaacaacgtttaccatgctagtaaaagagtttattactctgagtacacaaaagtacacaccaactaaacctacatcaacaacgaagttatgtttcggaaacgaggaaatcatggcagataagatcaccaccgcatccgccgcgtggctcaccgaccccacggtgttcgcagtgaatcgcacgccggcacattccaatcacgtaaccttttctcacattcccgcgatcggcgagccgagcgatttgaagcaaagcctcgacggcgaatggcgcgtggaaatggtgcaggcctccgacatcgatcttgaggaagagccgttcgcagccgaggatttcgacgattccgctttcggccgcatcgacgtgccctcccacctgcagaacgcgggatacatgaaccacaagtacgtgaatattcagtacccgtgggacggccatgagaatccgcaggagccgaacgttcccgaaaccaaccatgtggcactgtatcgccgcacgttcaccgtcgccgagcgtcttgatacggcccgtcaaaatggcggcaccgtcagcatcacgttccacggcatggccaccgcgatctacgtgtgggtcaacggcgtgttcgtcggctacggcgaagacggctacaccccgaacgaattcgacatcaccgaagcgctgcacgacggcgaaaacgtcgtggccgtcgcctgctacgaatacgcaagcgcatcctggctggaagatcaggattactggcgtttgcacggcctgttccgttccgtggaactcgccgcacagccgcatgtgcacattgaagatatgaaggtcgaagcggattggaatccggaaaccgccaccggttcgctcgacgcgctactcgcggtgcgcaatgcgaagaatgccgccaccgtgtcggcgacgctgaaggatttgagtggcaatgtggtgtgggaaaccgcattggccgcatccgacgaaaccggcatcgtttccggctcgttggacgtcaagccgtggagcgccgagagcccggcactgtacgaactgcaagttgtggtgatcggccatgatggcgcgatcgttgaaaccgcaacgcagcgcgtcggcttccgtcgcttccgtatcgaagacggcatcatgaagctcaacggcaagcgcgtggtcttcaagggcgccgaccgccacgaattcga

SEQ ID NO: 85 - DNA, 23350 bp, Bifidobacterium pseudocatenulatum
ggcaatcattgactataaagaagtagtacaaatacgctcttgagttctcaaaccaccaccgctcacccgcctcgaggaaccccaaccggggaaccactcgccgagcggcagcgaggagtcaatttacacgaaccccggcgatcacgcaaatcgacccttccaaagataccctggaaccgttgcaaataaacacatccctcggcgtgtcgaaaaaggcctccgaacggccgtacagccagtctagaccccgaagacaacgcccacatgaaccaaaaacaaactataaacggcgtgtcatacccatatacatctcattcccatgtgatgaatacccaaatgcaatcgcaaatcatgattccagcggaacagaaagaacagaaatacaaaagagacgcgaagaagcatgaaacctggctgcacttgcgacggcacgcacgctgaaatacaacaagagccgccgactcagggaagtcgacggctctcgctgtttcaattgttattcagttatgttttgacctgtgagaaggaagtgagatcaggcagtgacctcagtcttggccttcttgcgatccatgtagcgcttgatagccagagcctcaagtgcgatcaccaggattgcggtcacgccccaagccacgtacatggcggtcttccagatcggggtggcgaccttcggctcaccgtctgcatactgccagctgttggcggcggtgtacagaatattgtgggcggcggtacgcatggccttcacggaggttgcggacttgtcggtgatgtggttggtgatggaggtggtagccagcatggaatcgttgccgttacggatctcctgatcaccgttctggtagccgtagccgccgaaataatcggtcaggacgaagcccttgaagccccactcgtcacggagcacggtgttcagcagaacgttgttgccaccggcataggtgttgccgatgtagttgaaggcgctcatcacggcctgtgcgccgccttccttcacgctcatctcgaacggcttgaggtagatctcacgcatggcctgctcgttggtccaggtgcagagcatctcagtacgcttggtttcctgatcgttcagtgcgaagtgcttcatgaaggagtacacgcccttctccttggcgccggcgatctcgttggatgccatgacgccggagagcagggaatcctcggagaagtactcgaaagtacggccggagaatgcgttgcggtggatgttcatagccggagcgtaccaaccagcaacatgcatgtcgtgagccatatcgccgatcatctcgccgaactgcttggccagatccttgttccaagtgcaagcgaatgcggtggaagccgggaagccgatggagccaacaccagtgaagttgttgttcaacgaggccgggccgtcagcgtcggtgagctggatcttgccgacggaggagacggccggagtgccgtagccgccgttggcaatgaggttgtccatatcgtcgaaggtcagctcgtcaagcagcttctcccaatcagcatcgtcgtaatccttgccgtacatgtcggccaggcggaggccattcttggcaccggtggtcggcatctcgtcggaatcgtcgttgaactgagacggatcgtagttggtgttgttgtagaaggtttcctttgccttatcagacatttcgaagttggtcggagcggcggtggcttccttgtagtttgcgaaatgtcctgcacggctcaggtaggtcacatcgcctgcagcatcatcgaactggttggtggccacggtctggtcgccattgtgggtgttcgaatcggagtcgtaggtgatggtgtcgtccacggtgatcttcttggagccgatcacagtgtgggagtcggagttgatggagatgttgtaatcgcccttttcgagcacgtatgccttggcattcttgtaatcataggaagccatgtcatcgtcttcgaattcgacggtcacgtcctcggaagcgcccggctcaagcttctcggtcttctcgaagccaaccaggttggcactggccttttcgatgccaccttcggtgtacggcgggttgtagtagacctcaacaacatccttgccagcggtgtcgccggtgttggtgacggtcacatcaacggtgaccttgccatccttgtacgtcacatcgttgagcttctgctcgaaggtggtgtagctcagaccgtaaccgaacgggaatgcaaccatggaatcgtaatcgatggcaccttcggccgctgcggtctcatagaacttgtagcccacatagatgccttcggagtagttcacaaagcccgggatggcggtgacttcgtcaccagtgaagcccgtgtacttggcggccttgtcttccatgttggtgtattcgaacttgccgaagttgttgtaagacaccgactgggtgagatccttcaggaaggtgtcggaagtcttgccggacgggttggtatcgccggcaagcacgtcaccgagtgcggagaagccggtctggcctgcaggcgggcaccacacgacggatttgatctgcggatagtcgttcaggaagtcgaactggaaggtgttggcgccgttgtagacgagcgtgaccttgttgaagttcttggtgaccaggtcgagcatatcgcgctcggtctggctcagctgcaggaagctttcgccgtccttgaagtcctcgtaatccttggagttgttctcataggtgatgccttcggccttcatgttcatcggaaggtcagcgccctcgccaccgacgcgggtgagcactacaacagcctcatcggagaagctcttggcatcggagatcagggaatcggaatactggtcggccggaacctcaggcagggtccaatcctgggaccacatgccaacaactgggcgatctgcacggtaatcggtgtacagcttggtcaggtcggcgttggtctcgatgccggcttccttcatgccatcaagcagggaaacggtgtcatactggtcagacatggagccggagccggtgccgccgtataccgggttggtggagccccaaccgaacacgttgaccttcttgttagccagcggcaggttggaatcatcgttcttcagcatggtgatggcttccgactgcacttccttggccagctcgttggccttggaaacagtggtgtcagacagcatgtacttggtgatggtcgcgttgttgagcagcgtcgacagcggaccggacagcatcatggaaaccgcgacgacaatgccgaccaaagccacaagccaagactcggagtggatgatcttacgggtcgccacttccttcaccgtcttcttgttgacggcaaaagtaatgatcagcgcgagcacaaatagcacgccaatcgcaatcaggtacggcgtcaacgaaccgataacgttcatgacgtcagccatgttgatttgcagcatggtctgcctcctccttgattctcataaccaaacgacatgcaggctccgatttcctcatcgaaaccagaaatcatgcaacgctgccccgcgtcacgcaatttccagaagtgaagacacttcttcatgtcgatgtttcgatttcaccaaaatccgcgaaaaaagcaccctgatttttcccagcctgtcgtttcgcgtgcataatctgcataccacctgcgcatgtaaaactaccattcgtgcacatataatcccgttgcgcgcatgcatctggcacaatgtgcgctcatccgcagattgttgcaacatccttgccttgattgcggaaatcatcgatcttcattgcgcttccaactccataatcgcaattcctgcgatattttcggcacactacagcgagctgttccagcggcaacttacgtaaggcaagtaccatgggtgccatgagcgacttaagcgcattgaatctggaggcaggcagcctcgttggcggatacacgttgatttcccggcttggatcgggggcgatgggatcggtctggcgcgtgcgtgatgacggcggacaccagtatgcgatgaaaattttgcgcgattcccttgccgaggacgatgcgtccagcgaacgctcccgcgatcagctgaccgcacgcgagcgcctgcgtagggaggctatggcgctgcagaaagtgcgtcatccgggcgtgtgcggcattgtggatatggaattggatgatgctctggccttcattgtgaccgagctgatcgagggcaagaatctacgtgaagatgtgcgcgccaacggccggtatgtgggcgatgatttggaacggttgggacgcaagctgatcgaggcggtgaaggctgtgcatgcggccgggattgtgcaccgcgatatcaaaccgacgaatgtgatggtgtcgaataccggaccggtattggtggatttcggcattgccatgggcgagggcgaaagtcatgtgactcgtaccggattggtgatgggcacgcctggattcatcgcgccggaaatcatcgacggtgccgaatccgatgagatgagcgattggtggtcggtggcgagcgtgctggcatttgccgccactggcgagccggtgttcggcacgaaaccgatgatggcggtattggagcgtgctgccgcgggaagcgcgaatttggcgggattgccggctgggaccatggccgcgttccgttcggcgttggatccggatcgtacgaaacgttgcactccagacgagttgttgcaggcgattgcgttggatgcgttgaatccgcaagcttggatttcggggaatacttcggatgccgccgatagtgccgggtcggaggcgatgctcccttttgatggatcgcccgacaatccacgaatgctttggcgggcgttagactatgtgacgggagaagacgccatcggcacacgcaccttgccgcaattcgttgaggccacgcaggcaatcggcgcaaccgttattgctgacataaccgataccgttattgccgatgcgcccgatgtcggcacctcggtcatggatatcaacgcgcataccgcaaccattcctcttggcaccggcacgcgcgtgctgcctgtcaatagtggggataccagtgtgctgccgcaagatacaccgcaatccacgcgggtgatgccggtccaggacgcttggaatcccgctcaagaggccacacagatcgacccggccatcaaacctgcattgcagcgcatcgccaaccagcggcctcctgccgtaataccgaacgcatcggttgaaatggcgcaaagtgcgcagccacaagacatgcaaacatctgccgtgccaaccgcaccggtcactccggccgcgccgctcaacccgaacgtgccgcagagtgtactgcagccgccgaatccggccgacgtgcaacgcggcgaactgctaggcagaggcgtgcccctctgcgtgctgatggcgattcctgtggccgtatgcggcctgttctcgccatggatcgccctgatcgcgggcgcgctgctggcctggttgctcgccaccattggattcaatatggaggcgcagctggaacgcgaaggccgccgtgggggcagccgcagggcttccgactggttcgctcgcgccgccacgctgccttggcatgtgctcaaggggctgggttatgcggtgccacgcgcactgatcatggcggtcatcgccgcattaggattgacgattgccacagtcacgctgcaactgccgtttgccatggttgatacgtcgatattcggattcacgattccgctgccgacctggattgaagggccggtttcgcaaagcggcgtcgcccaggccggttgctgcgccatcggctggctggtatgcgccctcgctccgggagcattggtgctgcgattgggtgccggcgcattgcgcggccgcccgaaatccggcaccactgccgaatcgtacgatatgtagtgacgccatctcacgaaatacgcagcgaaaatcaaaaatcggcaaacgtttgcaatcatcagaaaaacatcagataatcgcacgtagtatggcaacgtgagcttttacgaaatacttcattcagcaatagcgtgcccacactactatggtgcacagcatcgtgatgtgaacatcgaaaggaatgtggatggcccagaacagtaaggatgcgcagaagcgcgccagccgcgccgagcgtagggccgctgaggccgcggagatgaaggctcgcgccgaacagatggagaaggagcgcaagcagcagaccctcatcggcgccatcgtgatggcggtgctggtgatcctggtggcgatcggcgcgttcaccgtgtatcacaacatgcacaagaacaccgaaacgcaggcttccacccagaccgtggaagaagcgtacgacaagctgcagcaagtcgaaaacacccctaagctcgtcgataagaagggcggattgctgatttcgaaggatggctacggcaagtccgtcgaaggcgcaccgactgttgcgatctacatggatttcctgtgcccgggctgcggcaatctgcatcgccagcttgatgaggatctgcagaagatggtcgacgcgggtcagatcaatcttgatttgcatttcatggcgtttatggacaagtggtccaccgacgattattcaagccgcgcagcgaatgccgcgatctatctggccgagcatgacagcgatccgagccatctgatcaccttcctcgaaaaaatgtacgccgaggatttccagcctgaggaaagctcgaattacaagtccgtcagcgacgatcagatcaaggaacagatgatcgcctcgggagtttccgaggatgtggcggacaaggcgttcggccgcgactaccaggattggcttgacgccatcgacacctatacgccgaagcgctccgaactgtggaacacgtccggaacctacaaagacagcatgaccaccccaacggtgaccatcaacggcaagttctgggatatgaaccagttgagcactgcgcaggagaccattgaggaaggcctgctggaggccatcggaatcaagtccgacgacatcggcaaggaaggcgtgatgccctccatcggctccgacaaggatccgatctccaacaccactggcgagtgatcagccctacgcaatcctcataatcgaaaaattatacccccctactcgccagcgtgccagccaaagcgcagttccaagttgacggtatcgggcacgctggttatgctattcaatcgttgccgtttttatgcattatgctagaaagcggcacaagcctccttagctcagatggccagagcggccgccttgtaagcggcaggtcgtcggttcgatcccgacaggaggctcgaaacccgttttgacgggctttgacctcttaccatgggtaagtgatccagaagccttcccccaacttatggcttctggcgaccggacgaggcttcccccaacctgcctcgtccgggcagggggcaggacatccccttctctcctgcccccttttttctttactccttttcctcgaaaatgtggcggtatagataaagccagcggaaaccatgccattcgtcccgatctgaccgttacaatgacggcgatgtaggcagtcgctggaaagaggacgtatgacaagaaggtggaccccccggagattcgtgacgcttcggcgtgttcgagtgacggcatgcgtggtctcgttgacgctcgcctcgacgctcgcattcggcgtaggcgcgcgcaaaaccgtggctctgaccatcgatggcgaaaccaccaccgtaaccacatacgcgatgagcgtcgaccgtctgctgcaggaacgcggcgtgaaggtcaaaacgcatgatctcgtggaatccaccagccccaccagcatgctgagcaaccatgacgtggtgacggtacgaagcgcctaccagaccaccatcaccatcaacgggcaggaagtgcccttctggacagtggcgaccagcgccgaacagctgatcggattcttcgaacaaaacgaagcagacgcggcaaaagtcaccgtcaatatcgacaacgtgtacaacaaactcaccggcggactgatcatcaaccaaaacgggccggtcaccgtcatcgcagacgggcaaagctccgaatcgccgaatggcaaactgccggcggcctccattcttgactccaaaggcatcacgctgaacaaggaggatcgcgtcagcgtcgaaaaagacaacggcgaaacgatcctgcgcgtccgccgcgtgacgcacggcgaggaaacacgcacgaaagcggtgcctttcggcacgcaaaccatcgtcgatcccagcctgcagcccggcgaagtcgtagtcaggcaggaaggcgaggacggcgaaatccagcaaacgtacgacgtcacgtatgtggacggcgagaaggaaagcgagacgctgaccaacgaaacgaccacgaaaatcgccctcgatcagattatcgcagtaggaccggcagcatcttccgacgattcgggatcggatgacggatccggcaattccggagataccggcaattccgataattccggaaagaacgacaattcgaacaagaacaacaattccgataattccgacaagaaagacgattcgaacagtaattccggcaatacggataattcagacgacaacaagaaggacgattccggatcgaaaacggacccggatccgacgccaactccagacccgacccccacgccaactcctgacccgacccccacgccggatccgacgcccaccccgacaccgcaaccttccgatccttcggcaggatgccgcctctatcacccctcccccgcgcaggcacaggcctacgcgtccggagccgcggcgcaatatggctggaccgggcaaaactggaccgatctggtgaaactgtggacgcgtgaatcgagctggctgtggtatgcggaaaacgcatcttccggagcctacggcatcccgcagtcgcttcctggcagcaaaatggcggcattcggcgcaaactggcgtgacgatgcggccgtgcagatcgactggggcctgagctacatcgcgcaacgctacggcagcccgtcgaaggcatgggagcattccgagcaggtcggatggtattaaacaacgccgatcgcaacaatacgcaaacgcaacagcgcacacttttcataccagttgaacggataatgaggtaatgacagaacacgcgaacgaaaccaacgcaaccgacgaaaccgcgcaaggccgcctgttgggggctgccgacattcggcgtatcgcggccgaggccggtatcagcccgacgaaaaaattcgggcagaatttcgtaatcgacccgggcacggttcgtcgtatcgtgcgcgaggcaggtgtgaccgccgacaatcatgtgctggaagtcggacctggactcggttcactgacattggcgattttggaaaccggcgccacgatgaccgccgtggagatcgacccgcccgttgcggaacgactgcccggcaccatcgccgaattcatgccggatgcggtggatcgtttccgcgtggtcaatcgcgatgcgttgaccgtgacgccggaaaatctgcctgatttccaaaatgatgattcgtttacactggtcgccaatctgccgtacaacgtggccacgccgattctgctgaccttgctggaacgtttcgacaatctcggcacgttcctcgtgatggtgcagaaggaagtcgcggaccgactgagcgaaaagcccggttcaaagatctacggcactccaagcgtgaagctcgcttggtatggtaccgcggaacgtgtgggcattatcgggcgcaatgtgttctggccggcaccgaatgtggattccgcgctggtgctgttcaaacgatatgagggcgggcacacgccttcggccaacaatcccgacggttccgtagtggaccgcgaaaacgtgttccgtcttatcgacgccgcattcggccagaggcgcaaaaccctgcatgccgcgttgaagaagatcgtgccctccgaagcgttcgagcaggcgggcatcgatccgacgcgccgtggcgaaacgcttgccatcgacgaattcgtggcattggcacgagccgtgggcgaggtgtcgcaagcatgagcgacaccaacaccgcaatcaacacggtcagcgtggactgcccggcgaaaacgaatctgaccctgcacgtaggcaggccacgcagcgaatggggtggccgacacgagctcgacaccatctactgcgccgtcggcgtgtacgacaccgtcaccaccagtcgcaaaaagcccggatccggtttctccctgaatcttgaaggtgcctatcttggcgatctggcctcctccggcagcgacatgcgacgcaaccatgccgtgctcgccctgttcgccatggccgaagcgagcggccatgaaccggatgtggcgttgaacatcgaaaaacgcattcccgttggcgcgggcatggcaggaggttccgcggatgcggccgccacgattctggcattgaacacgctatggaatcttgattggtccattgaacggttgcaacaggttgccgccacattgggcgcggatatgccgttctgcctgaccggaggctatgcgcgaggcaccggcttcggcgagcagatcgaacaactcagcgaaaacagcgacgccgtgctggaactgacggatcagggctttgcaggccgtctgctggtcggcgcgtatcaggcggaactgcgcacgccggaagtgtatgccatgttcgaccaaatcggcgccggcgcaaccgacaacaatcatctgcaacaggcgtcgatctcactgcatccacgcagcggacaggcgatcgacgaagcgttgcaggcaggcgccaagcaggcgttcgtctccggatccggcccttccgtaatcgcattcgtgccaaccgacgatgcggcacgcgccgtgcagtcggcatggcaacaaagccgttgcgtcgaccgcatcatcgccaccaaggcaccggcccatccgattgtgcatatcatcgcgtaacagtaaggttgaagtcaaccgatttttggagaaggactcgtacatgactcaggctaacgacgagcgcgccgcgcgcaaacagtacattcgccgccgtcaaaaggtggtgttcaccatcaccggcaccattttgacgatcgcattggtgatttccctgctgttcttcttccatgttggaggattgggcaatgtcaagtcggccgcggtacagccgaattacggccagcaggccccttgcgcagcacaggaacaggacggcagcaaaggcaagtacgtggaaaaccgcaacatcaccgtgcgcgtgctcaacggcactgaattcgccggcttcgcgcaagccgtcagcagcgcgttgcagaaccgcgagttcaacacccaggcagccggcaactacaccagctccaaagtggaacgcacgatgatcatcttcggcaagaacgccatcaatcaggcgtacacggtgaacagcaacttcaccgacgcgacgatggtgatggacgatcgtgaggatatgctgatcgacgttgtggttggcgcgactttcgacaatctgcagaatcagaagaaggtgccgaccgccggcaaggagatcgacagcttcgagggatgcgttaccgtcgacaagatgaccgacgtacagaaggcccccgaacacgacgccgtgtgatttgcagattttttgatttgcagattttcggattgacctcacgatttcgatttttcactgaaaatcaagatcgtgaggtcaattcttatattcgtgggttaaatcgcgggcgaaatcctccagagaatacccccgaaaccgcacttttcggaaccgactgacctcacgattctatttttgcccgaaaaatcgaatcgtgcggtcatagaatccaaatcgtgaggtcagcaagcagactactcggcctgctgttcctcataccaacggttcaactcggcaacagcgacatcacgctcgaccgggccgttatcgaggcgatattccagcatgtgcttgtacgccttgccaaccagcggtcccgggtcaatgccgagcagctgcatgatttcgtcaccgttcagatcagggcggatcgcgtcgaaatcctccttctccttcagatcgcgcacgcgctgttccatctcgtccatcgccgacgagaacaccatggccttgcgcttgttctgcgtggtcgcgtcggcacgcgtaaggcggttcaggcgctcatacagcggacctgcatccttgacgtaacggcggaccgcggaatccgtccacggctcctccacgtagccgtggaagcgcaagtgcagattgaccagctcgctgacgtcctcgaccatatgatggtcgaaatgcaatgccttaaggcgcttgcgggtcattttcgcgccgaccgcatcatgatgatggaagctcaccttgccacccgattcgaaacgacgcgtcttcggcttgccgatatcgtgcatcagcgcggccaaacgcaacgtcagatccggtgccggcacagggccgtccgggccggtttcgagggcaaccgcacgatcaatgacgatcatggtgtgctcgaacacgtccttatgacgatgatgttcgtcgatttcgagctgcaatgccggaatttccgggaagacgatatcggcaagaccggaatcgaccagcgcttcgatacctgcgcgcgggcgatcggacagcagcattttgaccagttcgtcgcgtacgcgctcagcggaaacgatttcaatgcgatcgaccatgtcggtcagcgcttcagcggtttccggttcgatacggaagcccagttgcgccacgaaacgtacggcgcgcatcatgcgcagcggatcgtcgtcaaacgactggcgaggatcgaccggcgtgcgcaacacgcccttggccaaatcgttcgcgccgccgaacggatcgacgaattccaattccggcacacgcaacgccatggcattcaccgtgaaatcacggcgggaaagatcgccttccagcgtgtcgccataattgacttccggcttgcgcgagtcggggtcatacgtgtcggaacggtaggtcgttacctcaacctgcacttccgtgccatcctcacgcctgcgcatggcgcccaacgtgccgaatttacggcccatatcccaaaagccatcgcgcccgaaacggcgcaaaatgtgttcaaactgctcaggacgcgccgatgtgcaaaaatccaaatcatgcgatttacgatgcaacagcaggtctcgaacgggacctcccaccaacgccaattcatagccttccgcggcgaacatacgccctaattcaatggcctctggccacacttcgaagttcacgccatccctttccggcaccacaagtttctgccttaccagcataccgttaccccacctgcacacagaattgagtatggttggaatcatgattacgcccgcagaccttgcacgcatgcttgcccatgctgcggacgaccatgcccaaaatccgatggaaccagacaaactgctgtacacatcgcagtccgtttccttgcggcaagagaccatcatcacgcccaacgcacccaccccggcaataatgccgcagcggcgcgccacggacggtccgaccacgttcgcctcgctcgacgcgcaggaactgccggtagtgcgcgaatattcggcgggaggtctcgtattcgacgacaagggccgtgtggcgatcatcgcacgccactcgcgtagcggacatttggaatggtgcctgccgaaaggtcatatcgaaaaaggcgaaacaccgcagcaaaccgccgttcgcgaagttcacgaggaaacaggaatcctaggtgaagtggtcgattccatcgccaccatcgactactggttcaccggaaccagccagcgcgtgcacaagctggtgcatcatttcgcattgcgtcagatcggcggcgagttgacggtggaaggcgacccggatcatgaggcggaagacgcgatttgggtggattttgctgatttggacgacgttctcagctacccgaacgaacgaaagatagcatggttgtacgcaaggaaactcaacagacaggcgtgaaggtgaatcaacccgcacaacggaacgttccgcacggcatgcgtgcgctttcggcaatcctcgccatggttatgaccatggcgttgatgttgttatacgcacctgtgccgaaagccgaagccgaagaaacacaggaatcgcaatccggcaccatgctgtcgatcgactcctccaccgccgtgctgaccgacacttccggctatcatttgagcgcgacggtgaccaacaccaccgatcaggaaatcccttcaggcacgctcacccttgccatgaacgccttctacacgttcgtgtcgcgcaacgatatccaggaatggtcggaaggcatcgggcagattcccacgcccaatatcgttgggcagagcgaggttcccgcgcttcaaccgggagcttcggcgaacgtgcacatcgacgcggactcgaatcaggagacgctggcgtccgtcaactcctgggggccgaaaccggtcacgctcagttatgaggccaatggcgttcaacaagacgaagcgcacactttcgcaacacggaccggagctggaatcaatacccccgacacgcccgcgatgaatatcaccatcgtgcagccgctcgaagcgcaaggatggaccaccgacaacaccatgctggaacagctcgtcaacaaaggtggcgtcacctccgcggaactctcgaaaatcgccgttcccggcaaagaagacgaggcacgactcaagtcgctggaacagacgttcaccaagcatgacaaactgcaggtggtggccgatccaacctatctgaaggcgatgccgatgccgacgcaagtcgacggcatcacgcaaccggccctgttcgacatcaccgcctattccgcgctgaacgacagcaaaacctatgattcggcaggcgtcggcacctcgcaatggaacgccgaacaggccttgaaaaactatcaatcggcgttgggtgacccgaacgcgagtatgaccacgtatgcatggcagggcaccggcaattggaccgccgacgcgctggcgaaagccaagcagcaggggtacgacaccgtcatcgccacgcatgatttcgaagaggatgatgcggccaccgcggaaaccggcaagaccgtagtaaccaccgacgccggcgacatcaccgtactgaccgcgcaaagcgtgctttccaaccttgcacaaggcaaggcgaccagtgccgacgccgaagcggacggcgagggaacaacggccgggcgtctcgcgcgattcgtcgcgcaaagcgcgttctaccagatggagcagccgtattcggaacgcaatctgctggtctgcctgaacggcaactctgatccggccgtcgtggacgcactgatgacggacgtcgaacaatcgccatggctgaacatcaccgatctgaacacgctcaacaacgccgaccccgccttgagcggcgacgatgcagccgcgatcgtgccgcaatccgacggaatcaatgatgcgacgcaagccaatctcaggcagacgctcaacacactggcagcctcgacaaacgacatcaaacgattcaacgcgtccatcctcaccgacgtcgccgacgatgccaagcaggcccccgcaggcctcaaagcgtggcgcaggcagctcgtcaacgcgcacggcatcatggccctgcacgcgctaggcggcgaaaatccagccggaagcaccatggtggaaggagccgggcaactggcgtccctgctcatcaacggcgtggccatcacaccgacggaaaacgtcaacgtggtcagcgaaaccgcgcaaatgcccgttaccatcagcaacagccacccctatccggtcacggtaaaagtctcatcattgaccaactccatgcagatcgtcacttcgcgtttcgacaccgtggaagtgcccgcgcacggcgaagcccaagtggcgttcattatccgcgtggccacctccggcaccgcggacgccacgctcagcctgcaggacaggcagggcatcacattcggagcgacacaaaccacccacatcaccagcgcattgcagatcagcgacaaaaccggcttcatcatcatcggcatcgccgtgctgcttggagctttgggactgtggcgccaattccaccgtaagaaggatccagacgaatgagttcttccgttggccgtaattcactgatcatggcctccggcaccgcggcctcgcgcgtgaccgggcaaatccgtaccattctgctcgcttgggctttaggcaccaccggctatgcggcgaacgcctaccaagccggatccatgattccgcaggtgatctacaccttggtttccggcggtattttcaacgccgtgctcgtgccgcagatcgtgcgcacgttgaaggcaaaagacgccgaaaccaaactcaacaagctcatcacgcttgccatcaccatgctgttggcggtgatgatcctgatggccctatgcacgccgctgctcaccaagctgtatgtgaacggtagccccgaaaccatggcgttggcgacctcattcaccctgtggtgcatgccgcagatcttcttctacggcctatatacggtggtcggccagattctcgcggccaaagaccatttcaccgcgtatgcgtggagttccgtgggtgcgaacatcatcagctgcatcggcttcggcacgttcatcgcgctattcggccgtgccaccgagcatccgcttgatttttggaccgccgacaaaatcgccctgaccgcaggcacgtggacgttgggcgtggcattccaggcgctggtactgttcattccactgaccaaaatcggattgaaataccgccccatcttcggccttcgtggcattggattgcgttccatgggaccggtcgcggcttggagtgtcggcattgtcgtaatcgaccagctcgccaatatcgtaatcacgcgtacctccactaacgcgccgatgctcgcgcagcagcagttcggcatcaatccgctcgacgtggccggcaatgcttcataccagaacgcgtacacgatttacatgttgccgtattcgctgattgccgtttcactggcaaccgcgattttcccgaaaatatcccgtgcggtcgccgatcataatatcgccgaagcgcgcattgatctcagccaggcgctgcgcaatatgggtgtgatcatgtgctatttcgcggtcgctttcgtggtgatgcccgttccgatcattcttgcgttgctgccgtctgtgagcgtcagagaggcgattcttatggcgggaccgttggtcacgcttggcgtgggacttccgttcgccagcgcgtatctgattatccagcgcacgttctatgcattcgaagacggcaaatcgccgttcattttcatgctgttcgccatgggcattcaagcggtaagcgtgatcatcggcgcgaaactactcccccctaccgaatggacgacaatgatcggcatggtaggagccatgagctacatactgccgatccccatcctgtatgccatgctgcgcaaacgattcgaaaacaatatcgacggtccgcgcatagccatctcgtatctgaaatcgattggcgcggcagtagctaccatgttcatcggcgtgacggtacgtgacagcgtctaccagcttgtcggcgcccaaatcggagcggtggacggtcatatgaactggattcaggcagtggcgtgtgccgcgctgctggccatagtgaccttcatcgtttacgtaggcatgttgcggctgctacgttccgaggaattcaaggaggcgatcgcactgatttcctcacgtattcccggacttcgcaagccgaccagccccaacgatagactggaacagggcgacgccgaaaacggcgagtgaccataggcagaacaaacgtttacaaaaagttgaaggaacccatgaaacctcagctgggagataccatcagcaatcgctacgtgctcgtttcgccattgcgcgaagaaaccggactgcaggtctggaaggccagcgaccatgtgctcgcacgggattgccagctgtttattgtcagcaacagcaaggcgttgcaggaagtcaacgcaaccgcttccatgctggctatttcgcatgattcccacttcacgaaagtgctgcagctccagcatgccggccaggtcgcgctggtggtgacgcagcttgacgaaggcatgaccctcagtgaatatcttgcgctgaacgccaaccagccgttgagccatacagccatgcgctccatcattggcgaagtcatcgaatcattgcatgcgctgcaaaaagacaatctcacgcatttctccatcagcaccgacacggtgcgactgacccgttccggcattcagatcgcagatgctccagtgagcatcatgcttgccgacacttcccgcgcgcaggctttggaaaatcgggaacagcttgcgatccgtcaaatctcagcgctgttgtacgctatgctgatccgacgcccgtccacgctgtcgacggatttccgtcttgaagcgctcgcaccgaccacgccgatggaattccgcgtgatctgcaagcgcggtctcgaactcgaagaggacgacggcttccccaccgttccgatggcaaccattgcggaattggaagcgttgcttggcgagtatcaaccgctgtcatcgttgggaagcatggatatcacgttgccttccatggattcggaatgctcaatcgccaatgttccgttactgcagattcttgagaaggatgtgctcccgctgccggatacgctggcagcggctggaagcattccggaaatgacgttcacggctcccgaaccgcataacgatttttccgatggcaaggaggctttggcgaaaggcgtcgcggccaccagtggagcggtgaaatcgttgtggagcagcggccgtgaactgctgagcgaagaagacatcgatggcgtgaccgacaccagcgattctcccttctccttccccatcagggtttccgtaccggccgatggcatgtcatccgacgattcccagttggaaaaaaccggtcgcattccagtaatcggcgcggatggtcaggtcattcagcccggcgaggagtccgcccgtgcgttgaaagcagagcaggaggcgatcgatgccgcgtatgccgccggtcaagccgcggttccgccgagcttcacgccgaagaatccttcttccgcttcggcgaatactgacgttgccgacgcgaaactgtttggcaagctgaaaacgaaggtcgttgcgattatcgtggcggtcatcgttgttgcggttgcgcttgggtttgcagttcatgggttgatgcagccttcagattcggttacgactgattcaaaaggaccatggccggaaataaatcttgacgaagtgccgttcggcgagggagatcagtcggatgcgaattccgcggattcttccaattccgatacgtccggcaataccgattcgtccaattccaaggattcttccgatgcttccgccaatacgccggcatccggcgagtctacggcgtccaagcaacccaagaaaaccgaggacaaggtcgtgaccgccgataagcagtcgaagaaagtgccggatccgaagcagccggaaaacacgaccgcgtacgaaatcgacaatcgtcaattcctgtcgaatcctgacggacagcagggctacggatattacgtgcatctgagccagccgcagaaggcgtatcgcatggtcatcaaaattcgttcttccggtggtcagggatatattcgcgtgaatgcgacaaacagcccgtcccaaggcgagcaggtggcgcagttcgagtttgacgcttccggcacgaccgacatcaagttcgacaaggccgtggaaacgcaggacatcatgctgtgggttccgcttgatagcctgccgggcaaccagctgtacatcgaaagcattcaagtgttctgatcgtcagcacatcgcaatatccgattacttctgaagattgcgatacgaaaagagcctgccatgcgtcacctcacgtatggcaggctctttgtgtatttattcttggaatatggtcgtagtcgaaaagcgatggaacttggctcaagaatcgacaaccaatttttcgccatttttatcactctgatgtcagaactctaatgtcagattcgggagcttgctcgcggatgatttcatgctgcgcgacggctacccccgtctctacagttccgaaatgccgcttgaactcttcttttcgtcatatctcagcacatatgtcgagcgggacgtggccggttatctcgatgtgcgaaacgtgaccgctttccacaaattcctgcgtctttgcgctctgagcggcgctttgtggcggctcgcgtggaatcaagttttcaagccaaagacgagcaggtatattccgccgcagactggctgacgcgctgaaacgtctaccccagcattagtctgacctcatgatctggtttggctggcctcatgattgtgatctggcgacctcacgatctgcgattttcacacgattttgattggctgacctcacgatttcaatcggggacacttttttccagatcgtgaggtcgccaaaacaaaatcatgaggccagatagaagaaatcgtgcggtcaactgacaaatcatgcggtcgctcacataatcccgtccgcacaacccgcacctaaaaccgattaccagagtcacacggacggaatcgcagctaccgccagcacaccccttactccggccaggattcgaagagggtgaggagcgtttcaacgttggtgtcgctccagctgtcgattctgggaccagcatacgtactgttgtatggctgatcgaacacgaccacatgctgccctgcctcacgcaaggtttcgatattcgccggcgaatcgtcaatatgaatcgtggcctgcatactgtctttcagcccagtaaagcacagactcatgtacggaatgcggttgctgtccagccattgcgcggtgtcggaaacgaccatctgatgctggccggacacgaacagccggtgcgtgacaatgcgaatgtacacgtgctcattcgccaatcgctgcaatgcctgcgcgacccccggaagcggcttcatcgtcgcatacagatgctcacgctccgcggctttgtgcgtttcgatgtaatcgtcgagcgtctcgaacggccatccgtcctcgcgcgtgagattgtaatgcgcggtctgcagcgcacgttccggcacgtcaatgccctgccgctgcaggtaatcgcggatcgcgcccttgtaatccgcgcaaacgccgtccaaatcgagattgagcacgcgatatccctgcacgcccacgcgctggctctcatattgttcaggaatagtcgccatatcacgttcctttcttacgcccgacaccaatcagcctgtcgaacagccacatcaatcagcccagcccaatcagcccgatatcaatcaatgtaacctgacattcgccggcaacaagcgcaaatactcccgcaaataaggaagatagaaaatggatagaacaatgccgaccttgcgaaaagtcttacgggagaacgattttgagactgtcatagaaaagatagaaaatctgaagatcgcgccgtttcttttgcgacggcaatactgccctgcaatcgacgattgatgttcatcacagcatcgttacgtttatttcaagattagccgatgaaaatacaaaagaatcgacgatcgttgcatgacatcgacggttgagcctgcctatgatgaaggcacaacagaacaaagagacacgatgcggcaggaaccggagagaaaaccggagccgcaccccacacgcggggaaacggcaacgccacccgcgctgaacataaccgaacaacaacagacttacggcagcggccagaggaaagaacagaaaacaagaacgccgccaagccgaacgaaaggaaacatcatgaagaacaacactttcaaccaggtcatcaacgccaacctcgcttccgtcgatccgggcttcggccagttcgcactcgccaaggccagcgccgacctgttcaagaaggtcatcaacaagtgatccaaggcctgcgcaggcaggcgtcacattaacacgaccgaagggcttgcgctccatgtggagcgcaagccctttctcatgttccgatcaagcgacgccaagaatccagccaccccagcaactgcacacacagcaccgcacgcaaccacgcacaacagctggtgtttcacgtgaaactctgtagatgatccggcttggaaagcacttgataatacgccataagaaaaaggaatgcgtgaaatcgtgcagtgcgcggctggttgctttggtggttcgctacagtgggaatatgagtgatttgcgagatgtgattattgtcggatccggccctgccggatataccgcggccatatacttgggccgggctggattcaaaccactggtcatcgcgggtgcgctgaccccaggcgggcagctcgtcaacaccactgaagtggagaattttccgggtttccccgacggcgttatgggaccggaactcatggataatatgcaacgccaggctgagaagttcggcgcggaaatcgtttgggatgatgttgtttccgtgagcaacaatgacgtcaccggcgtgaaaaccgtgagcgtcgatcagggagacgtttttgaaacccatgctttgatcatcgcaaccggatcggaatatcgcaaactcgacatccccggagaggcggaatattccggcaagggagtgtcatattgcgcgacctgcgacggcttcttcttccgagataagccgattattgtggtcggcggcggcgatagcgcattcaccgaggctgattttctttcacgatttggatcgtcggtgacgttgattcatcgtcgttctgaattccgcgcatcgcagattctcgtggaacgcgctcagcagaatccgaagatcaccatcgtcacggattccgtggtggaggaaatcttgggtgacgacaatggagcccaatccgtgaacattcgcaacgtcatcaccggagaaaccagcacgattgccgcaaacggcatttttgtggcgatcggccactcccccgccacagcttttattgacggcattgtgcagcgagatgcgggtggatatattcaggtggacggcgccagcacacgcaccagcactgccggcatttttgcagccggcgactgtgttgatagtatttaccgtcaagcgatcagtgccgccggcatgggctgccgggccgccctcgatgcccaagcctacctccagcagtaacacttcccatcacggtcataccctacaaaaacttgaaaaacgagcggaaggggcggcatattctgttcacgac

SEQ ID NO: 86 - DNA, 16653 bp, Bifidobacterium pseudocatenulatum
aagtagtacaaatacgctcttgagttctcaaaccaccaccgctcacccgcctcgaggcaccccaaccggggaaccactcgccgagcggcagcaagagataaacctacagcacaatcccattccacgcaaatcgggcatgacgaaacaagacgcgaacccttgcaaacactggaaagcatcggcgtgtcgaaaacacgggaaaaacgggctgcggacgccatcgcgtagcgaaagaccgtcggaaaaaccctgaaacacctcaccgcaaaccaacatccgggcgtgtcgcaaccacactatccgtttacggcccatcccccaagccaacccatccgagaaaacctcccagccgaaagctgaaataggagaaacagaagaaagcagataaacgaaaccgcaccgccgatcgttgtcctgaacacattcagatcccaactgatcgaaagtgcggttttgcatatgcgcgtgcaagcgacggcagaacaaggcagcgcagccaaaaatcgattaatcggtgcaaccgaaacggtagagggcccaaccctggccgtattgcgaataatcggcaaccttcaccaacgtgccgccatccacatacgtatcaatcaattcctcattgtggaaggaatcgtactgggcgcgatacgggaatgactgcagactctgcgcctggtcgcccatcgtaaggaagtattccggagcgtcggtcagcggacataccgtgccgagcacctgctgcgcatcgccggaagcaaacgcggtctccactttgccgaacggagcggatggcacatcggtgcgcgcattgatgatcggatacaacatgttcgcgttgaacagcgtctccgcatacatcgaaccgttcaacggatcggaaatgatggtggcctgggtgcccgtacgttccgtgaccttgcgcagcacagcgatcttttgctcggtgagctgctcgttggggtcgctttggttcagactggaatgcgcgatgatcgtgtcgcgagccgcggaacgcgatgggcatacgatctgcgcggaaaccgcaagtatcgcaatcacaaggaatacggcgattaggacgatccaattggaagcgaaagaagcgttcttcacggaagaaacagcagacgcagaagaaagggaaggaacggaagaagcactattcttcgtggaaaaggaagatgcagaaggagcgaaagaagcggatgcggcgcacgcggaaacgcattcggcaagagcgttgattccaatgacaagcagcggcagcgtgaccagcggaagcatggtcataatacggttttcatcgcgataccacggagcgctgatgatattcggcaacgcgccgaccagcgtgaccgtgcacacatacaccagcgcgaccagcaggaatgcggccgtcaacgcaatcacgtcacgcaggcgatcgttgcgacgaagtcgagatgattcggacgacgcggacgcggcatcagtggcgttggagtgcgacgcaggtggcggacaggaaacggaaaccggggaatcagcggcggaaaccgcaatatcagaagtcgaagcatcaacatcgacatcagcagaagccacgggaaccacagtggaagcagccgacgaaaacgaatccgaagcacgcgcagccgcgcggcgggaagcgcaaacgaaagcggccgcagttcctgcaatcagcaacagtgcgaacagaatcgcaggaaaaccgtcaagcccatccgtgagacagaacgaaatcgactcccacaaattcttggacggctgatggctatggaaccaggaatcgggattcgcccaacggtccgatttgaacgacgtcagcatcaacgccacaaacgccaccgcaccgacgcacatggcaatgaacgcgccaagaatcagcttccacggcaagcgcagcacaatgaacggcaccagaatcagagcatacgtgaatgcgatacgcgggtgcgcaacgaggcaaaccacgcctgcgacagcagcgatcgcaagccattttgctatatgctcgcgcgcggcgatcgcatcgaacaagcgcaatgtggcggcgatgaggaacggcagcagcgacgtggcgaaaccgaatgcgatcagcggaccggcattcagcagtccgtacgggtggcacaccgagctgacggcaagcacgggcacgaacagtccaatcagattccgcagaacgaaagtagcgtcgaaagtgacgttatattgccgattcacagctgacgatacctgctgatttgaaacattcgacgattcagatacggacgacgattcaggcgtagacgatgcttgagaaatacgtgaaattggattggaaattggattaccgcgattccaacgttgcaggaaatacctgcataataccagcattccggcagggaaaatcacgcccgaagcaatgatccacgtgatattgaatgccgcgtagatcgaacattgcacgccgaacagcgccgcgatcttaatcacaaggtaagcacagatgtgaaacaacggcggataaaacgaatcatgcggccacaaatgcagagccgcccccaatccctcgtcaagcagacggtgaatgaaatagtaatgcgcgggggcatcgctgctgacgatcggcgtattccacaccgtggaggggaaccacgcaatcaccaggcatagtgcggacgcgacgccgataatcgacgtaagccacggcaataacgcgtgacgcgatgcaggacgcagcatcgcgtggcaccgctgcaggccatgtttccgcccggacggaccgtccttggccaaatcattcctggctggaccattcgtagccgaaccatccttggccgagccattctgccgagcctgagtctgcacataagcctgtacatgagttcgcgcacgagcctgagccgagccacaatcgcccgacacggaaccggtattcgtaatctgttcggaagtcatcgattccatcgtagcgagtgccgcaaccatgctcaacgcttattctctggaatcacttttcaggaatcattcagacttcatgcaggggtataacagtgttgcgcaagaaaacaatcacgttggaagcacaagatgattgcacgggacgcatcatgcgctacgggcctgccttgctgcggagcgcgcgtcccggccaacgctgacgtcggcatgcgccggcgcgctataacagagaactggagaagtaccgcatgttcgttctcaagaacgcatgggcggcgcttggtcgcgtcaaatggcgcaccgcgctgatcgccctactcgcactactggtgtctttctcggctgccgtggacttggcagtgattcgagccgacgacaccgccaataatgaaacataccagtcgcaaaaagccacggcggtgattcggccgaacgcgcaaacacaagccaagcgcgacggtgccgattccagctataccgacaagtatttgacgtgggaaaagtacagcacgtatgcaacggccgcacagagcaacaacgtgaccttcaattatacgttggcaacatcggtgccggtgcgcgaaagcaagtcgttgcaggcgatcgccgcgaaaaacgacaccagcgaagacaagaccggcggcaacctgaccctgcaggcgttctacacgttggacgccgcgaaaatcaacgattacggctactacaaagtggtcaaaggcaagcatctgagctataagacgcagagcgacggcgtactcatctcgcaggcgctggccgataagaacaatctcaagatcggcgacaaggtgacggtcggcaatccgtcgaaggcttccgacacatacacgttcaccgtgcgcggcatttacgaatacgacagcgacgtgccggaaggcaacggttccgacgcgaaatacgcaaaggacaatcgtgagaacgtgatctacacgacgtatctcaatttcgccaagaacggacttgatacgacggatgcggaaggctgggccattccgaatctgaatatcatcttctcgctggcgaatccttccacctacaacacgttcgtgcgcttggtgaagaaggccaagttggacacgaagacatacgagatcacctcgccgtcgcttaccgcttacaagaagtcgatcgagccgcttgattccgccgcttcggcagcgcgcatcatgctgattgccgtgacgattgtcggtggcatcgctttgctggcattgattgcatgtgctgcgattggcggccgccgcgatgagatcggcatggcgatgatcacaggtgtgaccaagggccgtttgggatggcagttcatgctggaaacgttcatgatgacggttccgggttggattgtcggtttggttgcgggcgcgctgttggcgaagccgatcggcaccgcatgggccggcgggcaggctgtgtcgatgacgtccgcttcggtgtggaacgtgatctggtacggcttgggcgcatgcctggtgcttggcatcgtggcattcgcgcgcgtggcctgcttcaacctgaaccaactgtttgaggaacgctcggaggtgaaggcatgagcgacaatatgaatgataagaacgagaacctcgacgagaccgtggtcgacgagactgccgagaccgcatcaaacgagaccgtcgatgatgttgcgactgacgatattgcagctgacgcatcttccgctgattccattgaatccatcgattttgcggtggtatacgacgatgacaatgcagatatcgaaattgccgcaactgacggcgcggaaatttccgacgatgtaaacgatggcgatactgcagtagctgccgacggcgatgctgtggtatctgcagataatgcagataccaccgaagttgcagatgacgctgcaactgctgctgatactgcggatggttcggatgtggtcgccaacaatgcgaatcaggtgaaggaaacgcttgccttgagttcttccgacgaaccgaccgtgctggaatcgcatgaaatggtgaaagccgattccgcaaccagcgtctcctcacagctcgaccgcgaaatcaagcatcatcgcaagaaggatgcgtttttcttcaaagcgaatccgacgttcgcactcgatcatgtgaccgtgaccaatcgcaagaccggccgcaatattctcgacgacctgtcgctgtcgttccatgcgggcgccacgcatgcggtgctcgtggacgcggaggatcgcgaacagcatcagacgttgctggccaccatggtcggcatggtgcgcacggaccgcggcaacgtgatgcacaaaagcaccaacctgagcgacgtcgaaccggtcgaaatgttgggacaccgcatcggattcattccgcaacgtttcgctttccgccccgatctcgacgcggaaagcaatgtactgtacgccatggatgcgtcgaaccgcaacttcctcaagccgaagcctgtgatcgcccgcgaactgctcaagcgcgtgggcttcgacgaagtgacgtccggcctggcagtcggcgaagtaagcgaactgaaccagcgccgcgtggccatcgctcgtgcgctgagctgcgaggctgaagtgatcatctccgacgagccgaccgctggattggatgccgacgatgcggccgtggtgttggatctgttgaagaagttcaagcgcgatgccgatcgcaagcgcgccatcatcgtggtgaccaccaatccggaggtcgccgatgcgatggagcacagcgtggaactcgactagccgcctagtgcaacgggcgcacgaacatagactctttcgtgcgcccataggtaagccctttggaattctggttttagccaaattccaaagggcttgcgtgttccggaaacggtctgccctactccacgatacgcatgtggtactgctcggcgagcggcgtgacgtcaagcacgccgtatcgttcgagcagccgcagccattcgcgcctgttgctttcgccgaaacgggccgccttgcgcgcataggcttcggccgtcaggaacttcggcggaatcgacttgctgttgtacttgtcggccaccatcaccacttcctgctcaagattcatgggcacatagtcggccggaggcaatggcaatccttgcgattccaccgcttctttggtgagtcccacaccggtgtggttgcgcgcgaactgcgcgatagactcgtcaacaccctcattcaacaaatattcgtagcctttaagcccatgccgcacgtaattcggaccgtcgaatttcagcggtccaccgtcggaaccgtcttgcttgagcagaaaatacgtgccgatatcatgcaacagaccaccgatcaccaccagatgctcgtcgatcagcctcggcggaacggtcccgcccgtaagcccgtccgatgatggaatggaggggatgcgaagcataccgaacgattcgcttccattgccgtcttgcgtaagcctaaggccgaaatcgcccgccttttcaggggcatcgtccggtagtgtgcagcggcgggtgaacagtgcattctgcctgcgtgccatgcgacgtgcgatgtcggcgacgactacgcaatgtccgtgaatcaaatcgtatgcggcttgcgattgcgcgatttttcgatgcagttcgtcaacttgggcgagtgtaggaatatatccagttgtcataccgcctatcttaggcgctgtatgacgattgccgcatgctgaatccggtcgaaaaaaaaactggaaatccccgatgaaagtttcagccgaaaaattccgaaatacggatttcagatggaacgcacacgaaatgcgccggtacggttggaagcaacgatcatctgattgttttccaaacgagtccagccatcttcggcacactgatcgaaaccggagctggccacaaccacgcccttcggctggcctgcagcctgatccgcttcggattcaccgagcgtacgatagcgcatcacacgatagtcatgcgcctggtcgccacggccgtactggtcatagatttccacaatgcgcttggacgtgacctcacgaccggccgcgcacagagcgatgaattggtcttggctctggatcatgcagttgtagctggacttcggatagcttttgcgcagttcgcgcaccgcctgcgcgaccgcctcgtcgagtgcgaaaccaaaaccgatgtactgcaggatcactgcgaagaaaatggcggaatcggaacggccgccagtggactgcacgatgttgggatcgaccgggaacgcacggttggtgatgatgttgcgaccctgatcgtcggaaatatcgccattgtggatgaagctcaatccgttggcgtagaacggctgctggttctcgagaatcaacggcaggttcgagctggccaaacgcaggtgccacaggcctccacgagccggagtgttcgcaagctcgtcgaaaatcggatcatgtcgggctgcgatcgtgttcttgtagacggcggtgccggtttccggggtgggagcgccaccgtcacgcaggtacggcgactcgctcggcacggtgaccagcgcggagccccagccatcgttgtggatttcgctcagattccggaaatcgcgtacggcctgcatgccgagcacgccattgagactggtgttgcttccggctgccgcgaatccaagtaatctgcacatggttgattactctacagggcttgtaatgcaacgcgcgcatatggctatcgacattgcttatagcgtgcgaaaaacagcgtgattccaacgattcttcgagataagaccatgcaaaaacctacaaaatgccctacgaaaacgggctgcgtgatgatggcgatcgtatctgccatcgtcacgcagcccgtttcacggcttgtttcacacacgctttagccgcggaggacgctgagtcgcgaggaacagcggctgtatctcaatcagcggattgtaaggcgcaaggccgaaccatttgaccggagatcccgcaaaatgacgaatcgcatacttgacttccaaagaaatcgcgccacgctgcgacaccttcgactcaggcataagcgccttgtgtatcagcacatatcgaatcggaccgatattcggatcagcatcaagcttcggatagcggctttcctgcctcggcagatcccccgacttcgacaaatcgttcatgatctgatgaatgtaagctggaatcgactgagaaaccttgaaaccaagccgaatgcgaacacggaacatataatccgtaccgaaattctcaaccgaatactcgcgggtgaacggctcatcggcagtctcgacggaaaccgcccaccaagcgcgggcacgttttggatggtcggcgaaaatcgagaagaagatatcggtatcgatacgcttcgtctccggatccgacgtgaggtagacgatattgtcggcaaaatacggaatcgtatcgtcatcatgcaaccgcttcagcaccggtaggcattcggcgggctgcatatggcgacgctgcgcacgttccagcttcgtgccttcgttccacgtgtacataaccagcagaatcgcgaaggtaagcagcatcgtgaaccaaccaccatgcaggaacttcgccatggaagcgaagaagaacatgaattggatcgcaaggaacagcacggtgaatacgaccgctccgatacgacgccccgaatgccagatgtagacggcaagcagaatggtggtagtgatcatagtgatggtcaacgccagaccatacgccgcggaaatatgctcggaatcacggaatagcgccaaaaccaacagcgtggaaacgcaaagcaccgcattgaccacaggaatgtacagctggccgcgggtacgggccgggtaacggacctgaagatgcggcatccagttcagatgggtggcttcagacaccatcgtgaacgcgccggtgatcaacgcctgcgatgcgataacgcccgcgaccacggaaagcacgacggccacgtaacgcacgctgggcgtcatcatttcgaagaacgggttcaaaccgtgcgtgcggatgtaagccgaatcatcccaatgattgagcatccatgcgccttggccgaaataacagagcacaagcgcgattttgatgaacggccacgtgaaatagatgttgccacggccaacatgacccatgtcggaataaagcgcttcggcaccggtggttgacaggaacaccgtacccatgatggcaagcccggcggcattatggctgctgaacaggaatctgacaccgtacacggggttgagcgccgcgaacacgctccaatactgactgaggttcgccaagccgacaaccgccaggaacgagaaccagacaagcacgaccgaaccgaacgccttgccgatacgctcggtgccacgcgactgcacagagaacagcatcagaatgatggccgcggtgatcatcagggtcagctgcttgttttcagtgaaaagtttttcaaaagctggtagcgtctccaagccttccactgccgagctgatggacacagccggggtgagtacggaatcggcgaggaacgcggcgccgccgagcatggcaggaatcgcaagccatgcaccgtactttcgaaccaacgagtacagcgcgaaaatgccgccttcgcccttgttgtcgatacgcatggcaatcagcacgtatttgacggtggtgataagcgtgattgaccagaacaccaacgaaagcacgccgagcacggcttcgcggtcggcatgcgcaagtccgccctgcccgttgaggaacgtctgcatggtgtacagcggcgaggtgccgatatcgccatataccacgcccaacgccacgatcgccatggcgggcgtgattctgtttggaccggattgcagacggctccaccaacgaccgacgggacccttgctggccacctggtcaagtttggcggcctcctgctgtttctcctcgtgctgcttgatcagcacctgtcgctcttccttagtcagcaccttgtgcgaaaccttcggcgcctgcgtgtatgtggctgcgtgaaacagcggctcatcctcgtttggctcgttagccataacgctacctccaagtggcgggccttccaacccactccccaaaataaacgcaaaaaggcacgttaggagccttacgaagtcttgtcaaatcttcacattgtttcttgcgattcttgatctcgcacgaagtaaacttcctgtgggtttttttcttatttcacctcttgtctttctcttactctctcttattttcggataaatcgtttccgtcctgtcgattttcggaatttgttcagattccgtacacttcgcgcgtggtctttcgcgttgcctgcgcgacttccgtcagcggtttatcgagataattcgccaacgactgcagggtgtaggggatcatgtatggcgcgttggtgcggccccgatacggcatcggacttaggtagggggcatctgtttcgaccatgacatggctcaatccgacaatgcgcgccgactcgcgaataccatcgttgcccttatagctggatgtgcccgaaaggctgagataccaaccgttttcacgtgcgatctcacccatttcggcatcaccggaatagctgtggaacacggtccgttcgggagcgccgtccgccagcagcgtttcgatgacttccttatgcgagtcacggtcatggatctgcatgggcaggttcagttctttcgcgagcgcgatgtgcgcgcggaaggcttctcgctgcagttctttggcggcttctccggtgcggaagaggtccatgcccgtctcgccgatggccacaacctggttggggtaggcggtggcgaggcggtgcacttcggccatggcgtcttcgaagctggtgtcgtgccatggcttgtatttgagcggcaacccgtctgggcccggcaccccgcggtgaccgtggagcacggattcgttgggatgtatggcgatggccgcatgcacggtttgggggtgttcgcgtgccatgtcgatggccgtcatgaggttcggcagttcgcatccgcagtcgatgacgccttcgactccgacttgttgcgcttggttcagcagttcgtcgacgctgtatacggggacttccggctgtcctttttcttgcgcttcgtggctcatggcccgcgagaacggcacgacagacgccacatgcgtgtggttgtcgatgacgtgcgcgttctcgggaagtggttgcggtgctggcgcccagctgcggtcacgatggtgtttgctcatgcctccagcctacgctcgatggcagtcttgcttcggaagccgcgttattcatcgatggcagtgggattaaccaacgcacctccatatgttttgcgacgtagcgctgaaacgctttccgcgattagtcatggagggtgagggtggtgaaggaccaggagggggcagtgtaggcgccgctgattaggtcgattgcggtttcaaccggaacggttggcgaagccttgccgatttcaccggcgtacgggtcggttccggcgagcacggtggcggttgccgaagcgcgggattccgcggaaacaccaagctcttcaagcacttggttcagatcaatctcggcttcagcgtcgagcgcgttgacgatacgcacgtaggtgacgccttcagcatcattgcgagccacggtgacggtacggcggggctcttccggcttctcaacaccctgcgcaacaagctctccatcgatatacagcttcatgctttcgccgcgatcggccacttcgatgcgcacctgccacacggttccggggaacacttcgtccatggaccattcggtgccgtcaagattgtaggcggtaccgtcgcgcaccaccttgatttcgaaagcacgaccgaaggaggtgatgttgtggttcttgccgttgatgtcgccgtgcaccagctgcaagccccaacgaccctgatagtaggtgatggtggcgttgatggtgtaggcgtcagagtcaatgttgaggctcgtgttcatcggaccattgcctgcgtaatggcagtcctcaagatcgacatggcggccatcagcggtgtcaacgctgaagttggtgatgtcggcgtgagcggcaccttccaagcgcagtccaacggttggtggcagttcgcgacgcagcgtggtcctgccttccaccgcgaccggccatgcggtatcggacgtggtggtggcatacatctgctgcacccagtagctgtacggcaggtaggtacgttcgttgtcgaagtagatcagatcaggattccagctgtgatgcccgttcttggcaaacagcggcgcatacgaagacatgaccacggcatcgccgttcaattccatgcgacccatgaacgccgcttcggaaagaccgttgatcagctgcgtgttccacgaaccatactcgcccaagtacaccttcgggccctcacgatccgtggtgtcgtagtggtcgagattgtggaaccaccagctggaggactgataggaatgctcgtcaacgatgggaacgccggcttcacgcgcatactgccaaccagcctcgtagtcgggaccgctcggagccggaccgaccgtgccaaccacaacaatatccgggtaggtggccttgaccgcgtcgaagatctgctggaagcggttcctgaacacgtcatcgatgagatcttcgttgccgatgcccaaatattcaaggttgaacggttccggatgacccatggcggcacgcttggcaccccattcggtggtcgcggcatcgccattgcagaattcgaccaaatgcagcacttcatcgatgtatgccggcatgtcgttctgcgcgatcggcaccgggccctgactggtgttctggcagctcacggcggcgggcagcaccggcagcggcttcgcgccaatggtttcgcacaggcacaagtattcgtagtagccgatacggaacgactggtggtagccccacaggttgaaattgtgcggccgatgctcaacatcaccgatggtgcgatcccagtggtacatgttatccatgccaagaccgtgggtgatgcagccgcccgggaagcgcatgaagcgcggctgcaggtcggcgagcgccttgaccaaatcgggacggaaatgcttgagcccgttgtaggtggtgcgtggttcgagggtaacgaaatcaagatcaacggtaccttccgtggtgaaggtgagtcgcaaagcgccttcatgtacaacgatggcattgctctcaccggaaaccgtcagcgaaacctcttgcttacgccaatcgttggaatcgacggtgatatcttgttctgcaatcgcatttccatcgtcgtcaatcagagcgacggtgacgggaagtgcggaagcttcgcaattgttggaaatacgcatccatgcggagaaatcgtaggtttcgccggcacggaagaccatgccgtcccagccgatattttcaagcgaagccggcgcctgttcgacttcaacggacgcatagtgcgggttttcttcggctaccggattgtcggtgagcacgtcgaaggctgcgaaggagccggcgggcacgattttgcgccagaagctgtagttgctccagtcggaggagtcggcgcgattgtattcgaatgcgccgttctgtacgaggtcggcgttgagtccgccgtcgccggagtagctgatgtcttcgtagaagatgccccacaggtcggtgctgatgttgcgcacgcctgccttgttgagggttgcgatgatggtatcggtcatggcattcctttttgtgtttggttggtggtttgtcattgagttttgttggaaatttgatgattgatggcgatttatagcgactgctggttgccgtcagcgcgggtcgagtgcgaaccagagcacgccatgcgctggtatggttccacggatgactcgatcttcgccctcaccttcgatacgtgcgccggttacatcagtttcgccagttgcgttggtttcgtcgtcaaacagattggtaatcgtccacggatcgttgcgttggcttaatccgacgatggattgcagctcgatggttgccggcagttcgtagtcgcgatcgccggtccagaagatggctgcataatgtccgcccgaatgtgcggaaggagtgccatccgcccagtcggccgcatcggcggcccacaccacgagatccccaaggtaggagttttcgtcatcccaacgttcgaagatgcgttcgtacacggtttcgtgattgttggtggatcctgcggtgacttcgcgcaatgccggattggcgagcagttcaatggtttcgctggtactggtcggcaggtcgccgcctaccataagtgggctgcgtcccatgcaccagagggcaagcaacgtgcggctttcatcttcggtgaggcggctttggcgatcgtctccacgttcggcccgcaatccaatatgccccaacggcagcatgtcggcgtcagcccaatgaccggtggtctggaacggcgcccacctcgcaagacgcgggaattgctggtagatgtcttcccaacgatcccataaatcgtcgctgatacgccacatttgcgcgctgtctcgcagaaattcggtgtagccggtgctcacccaaccgcccggcgagagcgacaggctgatgctgcgaccgtatttcgcttcagctttggcgatggcgttatggtaggcggcgatttccgcgctgtggaatggcgtttgcatgtcgtcgactttgaggaagtcaagcccccatgaggcgaacaggtcgagctgttcgtcataccaagcttgagctccggagtggttatggttcagcccataattgtctgaattccacttgcacacgtggttaaggtccgccacctcttgcgccgtgtatggagtgcctttgaccggcagattgttgtcgaccgccaagcgcggaatgcctcgcatcatatgtacgccaaatttgagtcccatggcgtggatctgttcggcaagcggtgcgaaaccgtgcccgtctgcagcgctggggaatcgttcagggtcgggcagttgacgcccgtattcgtcgaggatcagcggcgcattggcattgtaaccgtgtgcgcgggcggtcgggtcataccagtcgatgtcgacgacgatcgtatcccagccggcgtctttcaggtgttccgccatgaatcgtgcgttggcaagcacttcgctttcggtgacggtggtgccgtaggaatcccagctgttccagcccattggcggtcgccatgcttttggcagatcctcggtagtcgccattgccttctccttgtacaacgttagaaaagcgtgccgtttacagtatctgacgtcatccttgacttacttgttcgacttcatcatcttggaagacttcagatatgtaccgttacatattttatagcatatttcagaaatcacaatcatgataggatatcggtgattctttgaaatttcaacgattaccagaaaatcatcatatataatatcgttacagaaaaacttggctgtaaggagcggtgcatggcaaacggcaaaccgacattgcgcgacgtggcggcggaagccggcgtctcccccatgaccgcatcgaatgcgctgcacggcaaagccggcgtcaaggaatcgacgcgggccaaagtgctggcagcagcgaaaaaactcgactatcgcatcaatctgacagccagcatgctcaaatcaggtcgcagcaacattattcacatcatcgtcaacgaattcgattcgccgttctattcgaagctgacgcaaacattgagccgcgagatcacctcacgcggattcacgccgttcatcgagcaaacccagtattcgccggacgcggccgaacatgcgctgaccagcaatccgttctcagggcagctcttcgacggtgagattctgcacgccaccggattgggcacgaatctaccgctcgccaaactcaacggcgggcgccctctcgtactgctcgacgcatgcgaggaaacgccaaccgtggatgccgtgaattttcccaacgaggagggcgaacgcgctgcgatgcagtatctgatcgcccagggatgccggaatattgcgattgtcgggcatacgttcgtgccgcgcgccgagttggcgcatgcgcagaacgcatttgcattgcgacttcgaggagcgtgcgcggcgttgctggacgcaggattgccatatgacgaaaccatggtgttcgaaggcggtcgctccgacgaaggcattaccgccgggcacgcgatcgccgaacggattatggcggcgcgaaggacggactgcggagccggcgcgggtgctggagaccgcgaaacaggcacggccggaaccgccgatttcaacgatgcaagcggcaagattacgggcagatcgatcgaaacgaccgacaagattcccgcaatcgcgttcgacggagtgtgctgcgccaatgatttcgccgcattcggcgtgattcgcggcctcgccgactatggcatccatgtgccgcaagacgtgaaggtgatcggattcgacggcgtgacttccggaacctacgccaccccttcgctgagcaccatccaagtggatctcgaccagcttgccaaattcgcggtcgatatgattgtcgaacggatcgaacgcggcgaagtgaatgacaattccagcaatgccagaaattccaatgatgcaggcacggtgctgccgccgagccgcgcaaccatcggatatcagttggtcgaacgtgaatccacgaccgcgatcatatagctatcgtgc

SEQ ID NO: 87 - DNA, 13972 bp, Bifidobacterium pseudocatenulatum
atgtagccttcgcggccttcgaacacttcgcggcgcatttcggcaaggaactcgtcgatgcgcggaccgtcggagcaccatgggaacgggctggaatagccttcctcaccaaccggataatcctcaatctcgcagccgtcttctcccggcagcttgccgttcttatcaacagtcttcgaaacctgcgtgatcacatccatacggaagccgtcaatgccgcgatccatccaccaattcatcatcttgtagacggccttgcgcacttccggattctcccaattcaaatccggctgcttcttggaatactggtggaagaaatactcgccgcgcttcggatcgtactcccaagcggaaccgccgaaataggaaccccaccggttcggctcggcacccggagtgcccggctcatgccccggcctggctggacgccaccaataccagtcggcatgcggatcgtccttgtcgcgggaagcctggaaccaagcatgctcgtcggacgtgtggttgaccaccaaatccatcacgatcttcagaccgcgcttgtgcgcttcggcaagcagctcgtccatatcctccaaggtgccgaacagcggatcgatatcctgataatcggaaatatcgtagccgttgtcgtcctgcggcgacttgtagaccgggctcaaccacaccacgtccacgccaagatcggccagatagtcaagacggctggtgatgcccttcagatcgccgatgccgtcgccgttcgtgtcttggaaggaacgaggatacacctgatacaccaccgcgttggcccaccacgggctcggggtcgcgccgttggaacgcacggtgtcgggaagggtggaacgattgaaattcgtcatgtcgtggagctcctttgcttgacgtttgttagattttcgttcgatctttcgtgactgactctgcccgttttcagctcatgtcagcttcatgcagaagatcgattttgcctactcccctatggtatgcaaccctgtttttctttctttcccgcggcgagttgtgcaaagcaagaaaagaatacgcttcttacggacgcgaaaaaccaatccgcaacaataaaaacgcgggacgttccagaaagggaaatggaacgtcccgcgctggggagtgggataggccagtcccgctcagagcggtgaagtgttacttcctgaacggacggcctacggccgcgttgtccctgccttcactcgcctatcggatcgctcagggagagcctatgaacagaccactgggctgttcacttaacggctcccctcatcactccaccgacgacccacttctgggcgaagatgtagacgatgaggaccggagccatggccatcagataggacgcgaaggccatcggatagttcgacgtgaactggctttggaacacgtactgtgcgagcggaatcgtctgattgctctgatcagtcagcgtgatcaacggcagcaggaagtcgttccaagcccacagtgcggtcaaaatcgcaatcgtggcattaatcggacccatcagcgggaaaatgattgtccagaaaatacgccaggtggaagcaccgtcgatacgagccgcctcttccaacgaaatcggaatcgaacgaataaaaccaatcgcaataaacaggttggtgccgatgccaagaatcgtgtacagaataatcaaaccaagctgattatcaagatgcaacgtacccatttccttcgcgaccggcagcatgatcaccgtgaacggcacgaacatcatcgcaaggaagaagtaatacaggaagcggaagaatcgcttatccatatttcgtgccacagcatacgcgacgaacgtgttcgtcagcagcgtcaacaccaccgcgcacacggtgatgatcgcggagttaagtgcggccttcggatagttcaccttattccatgcgtcggcgaaattatgccattcccacgtggtcggcaagctgaacgtgccagcctcgcccggcgtcttcaacgcggtgaccacagcgaaatacaacggcacgagcacggtaaggctcaacaccgtcacaaccgcggtcagccaccagttgaccttatgatccctgcggattttctccggctttgcttgcgcttgaacgccagtctttgcaacagttgcgctagtcatgatatttcctctttaccttcagactttcagacccttgctcagaccttttccttgccgctgaagaacttcagctgcacgaaggccaggattgccagcacgatgaagaacgtgaccgcgttcgccatctggtaggagtattcgccattgccaaggccgttctggaagatcagatacgagacggtttcggtcttggaatccgggccgcccttggtcaatgccatgatctggtcgaacgcgccgagcgaattcttgaggctcaacaccatgttgatggtgaagaacgggccaatcagcgggaaggtgatctgccagaagttctgccaagcgttcacaccgtcgatcgcggccgcctcgtaaatctcgttgtcgatggtctgcaggccagccaagtacagcagtgtggagtaggcaacgccctgccagatcgacaggaacacaatcgggaaccatgccaaatccggattggaaatcatcgacgtcgacagccaatcaatatgcagcgcctggccgagcgccggcagcggcgtcatgaaaatgtacttgaacacgtagccgatcaccagcaccgacagggtgtacggaatgaagaagatcgcacggaatccgtttttgaatgcgattttcgaattcagcagcaccgccaggaacatgccgagaatattcgtgccgagcgtaatcaaaactgcgatgagaatagtgaacaggtacgcgtgaccgacgcgagaatcctggaacatcgcaatataattcttcaatccgatgaatttaaaatcaccgtaaccctgcgaattagtgaacgagtatgccgcgccctgcaggaacggccaatacaggaagatggacaccagaatcgcagccggaacggtcatccaataaaatgccggatcgaccttgcgcttggaatatttcgaaaccttattcttggaagtttttgcagatttcttcgcagtatttgcagtatgtgcggtagtcatgtccgttcctcctctcacctgaagtttctggcttcgatcttgtcgtattcggattgcatgctgttcaggaatttttcggtgttgcccgactgaaccagcgtctgcaggaagcctgcgatgttgatgctggctggcacgtaatggtcgcagaagtcggccagtttgcccgcctggtagaagtcaagcacgccgttcagcgcttcatcgcccacatacgtgtctttgtagggggtaaaggcggactgctgcttggagtagtccttgatgttttcgtcgttcatcaggaagtcgatgaattcgcgcgcttccttctcatgcttggtgtgtgcgcccatggtcaggatcacgtcatcgcctgcggtgagttgctgttcgctggcatcgtcggttgccggcatttgcgcaaaacgcaagttggcatcgctgttgatgagtcggatctgcggaatcgcgtaggtgccgagtggcagaatcgcggctttgcctgcggccagatcctgcgtggcctgctggtaagtgacggccggattcttctgcgtgtagttctggtagatctcgaccagctgatcgctgacagtgccccacaggtcggagaatttcttcgatccgtctttgagggaaagatattcggattccggtaccagcgtggagttgagtgacgccagcggcgcctggagtgtccacggatcagcggtgctcgcttcgatcggtacaatgcccttgctcttgaagcgttgcagcaggtcgatgaattcgctccacgtctgcggtggattgtcgggatcctcgcccgcttcttcccacacgtcagcgttgatgatgtagccggacgcgttgcccgcatacggcaggccgtacaggcgcttcttggattcgtcgttggtttgtacaaggctcttggcgatgttcaccatgcctggattgagttcgtcgacgatgtcatcgtcggtgaaatcgtggaaaacacccgcttcggcgagcatgccgaaattaatgtcgccattgatggtgatgacgtcgggttcacgatttttcacgagtcgcgtacgcaaatcagtggttgcgtcggacgaattgttgacgttgactttgatgctgggatgggttttctcaaattcctttgcttttgcggtgaaccagtccgctgcttcggctttgaattggaagaaatccaaagtgacggttccagcggtgctgttgccgcaacctgcaaggccggccgtcaacgcgattgcgcatgtggccgtgagagcgcggtatacaatcctcctgaatttacctacactagtggtggaatcaggtttcattctcgactcctttgtattttttctctattacggtggagcggcttccttaccacaccaccgttactgagaattatagaggggggcggttttcattcccaactcagcgcgcctgtgcggggcggaaaacaaaaacgacgagattttgttactctgagaaagtaatttgacgcacgatgtgcgcgaacgggagcacgaaggatggttcagatggcggtttcacctctgccacagtggtttgaaggctcggaatatacccataaagtcgcggcttgcatcatgaaatatggtccgatttcacgcattacgttggcgcagattttaggactttcgcagggtgctgtttcccgaattaccagcgatcttatttatgcgggcgtgattgaggagacgccgatgccgtccggcaaggccggcaaactgccgaaaggtttcgtgcagaaagaaaatacggaacgtcgcggccgcccgcaaaccggattgcaggtgattgcgaatgcgcgatctttcgttggcatgaaaatcaacgcgacgcatatttcggcagttgcggtcaacgcaatcgggcagatcatcaccggatgccatgatctggaaatcgaagacgcttccccgcagaccgtggtcgcgctgatcaaacaactgacgaccgactgttccgacgaggcggagatggcgggctggccgaaaccgtgcgctgtgggaatctcgcttggcgggcatattgtcgacggtaccgtggtgacgttcgcaccgttcatgcactggtcgcagcccgtggaactttccgtcatggttcgtgaggcgaccggattgcctaccggaatttacaacgatatcgattcgttggtggttgacgcctgcctgtttggaccgggcgttggattggatagcttcgcggtgctgacgttcggcgcgggcgtcggctattcgttgacgttcaacggcgagctggtaagctgtccggataaaagttacggtttggtcgggcatattctggtcgatccggatgggccgcgttgtgtttccggacacaagggatgcgcgcaatgcctgtccgacaactcgatcgcggcggaatattcgcaaatcatcggacatcccgcatcattcgacgatttcgcacgtgacgcacgcgcgaacaaaccgcaagcgacgaatctggtgaaccgcacctgcttccgtctcggcaccctggtggcgaccatcgccaatcttgccatgccagacaaaatcatgatcgccggagaatcgtcgttcatcgcgaaattcggcattgacgacttgcgtaacggcatcaacatgtatcggcatagccaggccgcgccagtggattttgaaattcccgaccacgattgggctttgtgggccaaggcggccgcatcacaggcaattcggcaatatgttggctgattgattgcgattgattgtcttgcaatacaaaaaatcctcccttttgttcagggaggatttttgttatgcgattacggcttattcggcgctctcgacgggcgcaagcacggccttgaaaaggactgcttgcgccgggtgcagtgccggcgggcggatgccgtacgtggcgagcgcgcgtccggtcatcctcacgcctccggccttccaccagccgagcgggctctgtccgttggcgatgtcttgcttggcgaggtcgaggctcacgtcgagcggcgacacctcatacaccttgtcagggtcgagtccgggcaggcgtaccggcgcggccgggtaggtctgcgaggtggtgagctgggtgaaacggtagatggcggccgcttggttaggcatgaccacaccgtccaagcgcactgccggatcggctgcgtcggaatgcacgactgtgtcgacggcgaaccattcgcgatgcttcttgaattcggcgacccattcggcgagcttgtcgatatcttcctgcggttccttgagcaggttccattcgatgcccatgtgtccgaagaaggccatggccatacgcagttcctgcgtggtggcgcggtgcgtggagtgcgccggggatgcgcccacatgttcgccgatcatttccggcggcacgagcaacgaggtgtagcgctggatgtcggcgcgttccaccgggtcgacgcagtcggatccccaaatgcggtcggccacttcgaggatgccgaggtccacgcggccaccgccggaggagcagctttcgatttcaagtcctggatgcgcggccttcagatcagtgaaaatgcgatatacggcgagcgtctgctggtgcactgccgggcgtccggtgcgtggggagacagcttcggtgacgagtttgttgtgatcccacttgatgtagtcgatgccgagttcgccgacgagcttgtccattgcgccgtaaatgtagtcgtaggcgtccggattggtcaggtccacgacctgctgggtacgtccttgcatgggcagacggccttcggtgggcttcaacacccaatcgggatgcgcgcggaacaggtcggaatccgggttgaccatttccggctcgaaccacagaccaaattcgagtcccttgccatgcacataatcggcgagcgccttgagcgacttgtcgccgtcgggccacacgtcctgcgagatctgccagtcgccgaggccggaggtgtcgtcgcggcgggagccgaaccagccgtcgtccacgacgaagcgttccacgccactttccacggccttgtcggcgagtgcggtgagggtgtcataatcgtggttgaagtagacggcttcccatgtgttgagaatgaccgggcgcggcttgggcgcgatgttgtgttcagcaagccagtcgcggtgcactcggcgaatgtagctgtggaagcgggctgcgacttcgttgaggccttcgccgtaggagccgatgagccatggggtggtgtaggactctccattggcgaggctgatttcgccgccgaacagtacttcgccgccgccgatcacgccgctggtgtatggcaggcgttccgcggagagcacgctgttaccgctccatgccacgtgtgcggagtagacgttgccgtgcgtgaagccgaagcctttttcgccgacgctgagcagcagggtggcatcgaagtctgggcgtccggccatggatgctttggcgaagcggccgagggtgaagtcctggcgctgcggggagcgttcgcgcagatggtggccggtggtggtgaggatttcgttggcgtcggccggcacggtgaatgcgagttcgatcttgccgacttcgagctggccttcgccggtgttcacgacttcggcgttctggcggatgaggccggtttcgtcgagttcgcaggtccagatgagtttcacatgctgttcctcgtcttcggcggtgacggtgacggttggggtctgcttgggttcgtcggccacgctccagttcgggtatccgtctttttcgcccatgacgtaggttttgccagccgccacggtttcggcggtgatgttgctgactgcgaacttgcagaacagttccacgccgtcgcgacgcacatcaaagcgggttgcgccgatccaggattcggattgcgtgggcagcacgctcggccatgaggtgtagtcgagtgcgccagaaacacgctgtggcatttgcgcgtcgaacatgtcgatcacggttgccggggctgcgagcgggcgaccccaatgcacgagtcgcggcagatcattgccggggaatacgagtgcgaacgccacgtttgcggctggctgttcggcgtagaccgcagtgagttcggtaccgttggtagcgttgccatggaaggtctgaatgagcgtcattgcagcatcctttacatattgcgattgccttgtactgtcaccttcgatggtatgacaagcttcatttgttgacgtcgccgagcgtgtttctttctgtcggaaagtatttcttgcgaccatagaatcgcaagaaatattattacgtaaacattaccgttgaaatcgcaatcatctttaccaagatttacttggcatttcaatatttcttacgtttttgcgactgcaaaatcgcaattatcgttttccagcgaaaaaatcagtcatcaatcgtgcgcattccgattcacgaacgccgccgataacttccggaacatgaccgacatgcgggtcgcgaggaatgtcccaaatcgaaccgcatgcacccaacttggcatcccacgcgccgaacacgattcgtccgacatgcgtttgcaggcacgcgccggcgcacatcgggcacggctccaaggtaacaatcaacgtgcaatcggcaagattccacgtaccaagcgaccgagcggcctgcgtcatggccttgacctcggcgtgcgccaacggatcggcgtgcgcctcgcgcagattacggccactgccgatcaccgctcccccagcgtcaagcacgacggcaccgaccggtacctcgccttccgcggcggcctcgcgggccaattcaatcgccagctccatgtcgtcactccactgcatacccgccactatacggttccgctcgcgtgaagcgaaagacgaaacacgcccataaatacctcttggtaggctggaagagattgaagaaaacgcgcaaaaaggaggcacgttggcggcattcgagttgattgtatgtattatcgccgccgtcgtactatcttcattcctcagccgtttcattcccaaggtttccacaccgctcgtgcagatcgcgttgggtgcgctggcgtcgcaattgccgtttttcccgaacgtcacgctcgatccggaactgttcatggtgctgttcatcgcgccgctgctgtatttggaagcgcatgaaatcgataaaagcgagctgctgaaatccgttaaattgtcgctttcattggcaattggactagcgatcgcaaccatggtggccgttggtttcgcactgcatgccgtatggcccgcaattccccttgccgcggcactggcgctcggcgccgcacttggaccgaccgacgcggtcgccgtatcgtcgctcggcaaggaagccgcgcttacgcaacgtcaaaccagcgtgcttaaaggcgaatcgctattcaacgacgcgtccggcatcgtcggcttccagttcgcgatcgcggcggccgtcagtggcgtgttcacagtgggcgattcggccgcacagttcgtgttctcattcttcggcggcgccattttcggcttggcagtaggcatggtcgccgacctgttatttgaatcgttgcgatctttcggctgggagacgaccacaagccgtattttgatggaattgttcctgccgttcattctgtatttgggtgcggaagcggtgcatgtttccggcattctttcggtagtgacggccggtttgatcatccgtttcgaccgcaccggcatcggcccgaatgtggctcgcaccaacattgtttcgtcaagcgtatggggggtattctcgttcacgctcaacggcacggtgttcattctgcttggcatgttgctgccgaatgcgatgagcgcaagctgggacgatccgcaagtcagcaattggctgctactggttgcgattcttacggtttccgcagtggtaatcatcatgcgattcctgtggatttcattgatgctacgtctcgcgcgagataccgtcaccggcaagcgacgcaagatgacggcgcaacgttggcgttcggccgcggtcatgacgttcggcgggccgaaaggcaccatcaccctgtcattgatgttcacgatcccgtacaccattacgggaggcgcgtggttccccatgcgtgacgaactgatcttcatcgcaggtggcgtgatcgtcgtaaccttgctgctcgccaacttcctgctgccgctgctggcgccgaatcgcaataaagacacttccgtggaaatgaccgaaatcaccatcgaagtgctgcgacggaccgtggaggaactgacgggacgagtcacacccgacaatcgtcgtgcggtgctgatgatcatcgactcgtatacgaaacgtatcacacgactgaagcagcgcatcggagaaatcgatccgcaagggtatatgcaactgcagatcgacgcgctcaactgggagaaggaatacgtcaaggcgcgactggtgaaagtcaaggcgacgccgaacgacgacaaggcagcgcacgatctggaaatcgaagcatgcgagcgcctgctcgaccagatcatgagctctctgcgccatatcgaaacggaacataattccggacgcaccatctggcgagtcaaaggccgcttcagggcgttgcagaggcgtttgggcacggtggtgaagcgtgtgaacagccgcattcgccgcactaccccgctgttcagcgacgacgagctgttcgcgcacacccgcgcggtgcaggtggatgccatcgaacatgtgatcgaccgcctgtatgaggagatgggccgcgacacgtacaatacggaacattgctcggcactgctgttggattaccgacgaggcgaggctacgctgaggtcgcgcccgaatgtgggcacgagcgcggaggcgcaggcgcaggcggaagaggtgaagcgcgaaagctacggtatcgagctgggtgtgatccaagacatgtacgaggcgggtgacattacgcgcgcgcaatccaagcagctgcgacgcaacgtgtatgtgatgagcgtggacgccgacgcgcagatctagcatccaactgatctgatgggatcagcaagctggcgtgagccggtgatccgcagtgagtttgtctgcggacgaactgtggaaacgtgggggacgagacaactgtaggaacggaacacggcgtggaaggcggcaaactggaggccattccacaatctaaaacatgagggaattgaaattctcagatatttcccagaaaacaccagacatgtactcagcatcgtctgtttatataggagatgtcagcaaaagagccgaccaggaacccacagcagttcccgacaattgaaccctttcttcttctctctcctttctctccccggtggttttctctccaccggggtttctttttgccctcaacgggtggattcctccagccagtgggagaatccgcccgctggcagctcactcaaagtccagaaaccgccactcactggaacaatcaccccgctggcaagccgcccaacgtcccaatccttccagtgactgggaggattgccccgctggaacgggtatattggaggcatgagtgaaatacgcgagcacgagaccagtgattcccacgactccagcaacccaaacaccccgaccggtctgatcgggcgcgaatcgcaggtggttccagggaggttcggcgagccgctgcaggtcacgcacgtacagtattcgcgcggggacggcaatgcggctccacgacgcccgctgttcctctgcctgcacggttggggctccaatgaggccgatttggccgacatgatgcgttacgtggctccttataacgatttcgcgtcgttgcgcgcgccgctcgtgctgcaggaggctggttccggtgaattcggtttcggtcagggcgcgtattcgtggttccatgattgcgtgccgtccggcgaagacctggatcgagacgcttatgctgccgctcaagccattgacgattgggttgcgcgcaatgttcccgaagatcgcgctgtagtgccgatcggtttttcgcagggcggtttgctggcgattcatctgctgcgcgtccatccggaacggtacgccgcgtcaatctcgctttccggcttccttgcgccgggaatcgtcgccggtagcgcgccggccgacagtcatgtcgcggaattgaatattcctgtgttctacggctatggcaagaacgataccgtgattccgatgccggagcttttcgcaaccgccgcttggctggacgagcatacgttcctcacgtcgaaaagctaccgtggactcgatcatgcggtcagtctcaacgaattcagcgatttgcgcgactggcttgccgcgcacgatatcgcgccgggaatcctgtaagaaatcctgcggaagaatcccgtagaaaaatcctgcagaaaaatccgatgcaacggattttgcgtaccaagcacacggcaatcgttacaacccgatataagccacgatatagcgataccgcgttagactagagccagctaataatcatttcgcaattgccggcattcgcacgctcaaccatgcgaacgttcgaatgttggcgagcgccataccggcacattcgcgtgcctggcaataaggagtttcgatgctgctgtccgatcgcgacattctcgccgcgcaggccgaaggtcatatttcactcgatccatggaccccggaaatggtgcagcccgcttccattgacgtgcgtttggaccgtttcttccgtctgttcaacaaccatgcgtacacgtatgtcgatccggctgagaatcagggcgagctgaccgagcagttcgaggtggctccgggcgaaccgtggattctgcatccgggtgagttcgcattgggttccacgtgggagtacgtgaagcttgatccgacgattgccgcccgcctggaaggcaagagctcactgggccgcttgggtattctcacacattccaccgcaggcttcatcgaccctggtttcgagggtcatatcacgttggaattgtcgaatgtgtcgacattgccggtgaagttgtggccgggcatgaagatcggccagatgtgctttttccagctcagctcccccgccgaacatccgtacggttcgcaaggcaccggctcgcattatcagggtcagcgcggtccgacgccgagccgttcctacgtgaacttctacaaagccgacatcaccgactaatcatcaaatattcttggattatcgcaatatattgtcgatatatggcgattgatattcccccaaaaatacaaaaagattggctatcacatatcgcatgatagccaatcttttttgcaatcttctattgagatttcttgttgcaatgtcagcaatatcgaatgatattaaaagatactgcaacagcgattggcaacgccctttagcgctggatcgcgatgtgtgagatgccaggttccgcagcattcgcaccgatacacccatagttcagtgccgcgttcacgccagctctggtcggcggcctgccgggccgtcgctttgtcgcgatacatgattttgttcgattcgacgcagcgtttgggtacgaaataatgcatagttccccagtctattccaccatcggataagggcaggaagctcccctggaattcctgggatcccccagcgtcccgggactcccagtgggtggaggaatccgcccgcccacgggccttccggcggaacaaaacacccagtgggtggaggaatcctcccgcccacgggcctcccgacgtcccgaaacctccagccgatggaggaatcatcccgccggcagtccttccggcgtccgaaaacctccaatgggcggaggaaaacgcccgtgtgcgggaataagaaaagggggttcccggagcgtcacgctcgacgggaaccccgacgttgaatgcggcggcgtgctactctcccacaccc

SEQ ID NO: 88 - DNA, 5605 bp, Bifidobacterium pseudocatenulatum
ggtggtggtttgagaactcaagagcgtatttgtactacttctttatagtcaatgattgccagttcatcgtccgctcgttcgcgagtggccgggaggccttgaaggacggtgaggttttcgtgcgatgcgcctttccttataaggcgatcgtcaattttcttgtttttgagagtcacatgttggctttctgcaaagtttttttgtggagggttcgattctggctcaggatgaacgctggcggcgtgcttaacacatgcaagtcgaacgggatccatcaggctttgcttggtggtgagagtggcgaacgggtgagtaatgcgtgaccgacctgccccatacaccggaatagctcctggaaacgggtggtaatgccggatgctccgactcctcgcatggggtgtcgggaaagatttcatcggtatgggatggggtcgcgtcctatcaggtagtcggcggggtaacggcccaccgagcctacgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgatcgggagcaagccttcgggtgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacagccgtagagatatggcctcccttcggggcgggttcacaggtggtgcatggtcgtcgtcagctcgtgtcgtgagatgttgggttaagtcccgcaacgagcgcaaccctcgccctgtgttgccagcacgtcatggtgggaactcacgggggaccgccggggtcaactcggaggaaggtggggatgacgtcagatcatcatgccccttacgtccagggcttcacgcatgctacaatggccggtacaacgggatgcgacacggcgacgtggagcggatccctgaaaaccggtctcagttcggattggagtctgcaacccgactccatgaaggcggagtcgctagtaatcgcggatcagcaacgccgcggtgaatgcgttcccgggccttgtacacaccgcccgtcaagtcatgaaagtgggtagcacccgaagccggtggcctaaccctttgtggatggagccgtctaaggtgagactcgtgattgggactaagtcgtaacaaggtagccgtaccggaaggtgcggctggatcacctcctttctacggagtttttcaggacgccggtccggcgtccgtcgtgtggcccatgcgccggggatcgtctccggtttggcgtgggcgtgctggtgtggaagagatcgttggcttcgcgggtccttggggccggcggggagcggtgcggatatgcttttgggttcccggaccgccacccgcatccgttttgggtgcgtgcggttttccggatgcccctggcgggacgccgtcggccttgcgggccgcgggtcgggtccggtcggggcgcgtggtggtttgagaactggatagtggacgcgagcaatgcgatgatgtgatgtcatcgtttgctttatcgcgatttcgccaggctcttcttttttggatgagtctggtttcgagatcgatcgttttgtgatcattttttacagtgtgatgatttgtcgtctggcgtttgaagctatcattgggtttttcggggcgtgtgccgccctgaagggcgtatggtggatgccttggcagacagtaccgatgaaggacgtttgaggatgcgataagcctcggggagcctccaacatggcttcgatccgaggatttccgaatggggcaacccgccggccgtcatgggccggcacgggacctttgggttccgggggtacgcagggaagtgaaacatctcagtacctgcaggaagggatactccgtgagtagtggcgagcgaaagcggatcagaccaaaccatgggcgcgtgatacccgtcgggggttgcgttcgtggtgttgcgggagcgtgtgtcccggttccgacggaccgggcgggagtcataaaacggcttgccaggggaacaggcttgaaggcctggccgcagagggtgccagccccgtacctggaagcttgccgtcttccgatcatgtgtcccaagtagcgcgggcctcgtggaatcccgtgtgaatcggccccgaccgtggggtaagtctaagcatacctgtctgaccgatagcgtaccagtaccgtgagggaaaggtgaaaagcaccccgggaggggagtgaaagagttcctgaaaccgtgcgcctacaatccgtcggagcctccttgtggggtgacggcgtgcctatcgaaaaatgagtctgcgagtcagtggtgcgtggcgaggctaacccgtggtgggggagccgtagcgaaggcgagtctcaaaaggcgttttgagtcgcgcgccctggacccgaagcgggatgatctagccctgggcaggttgaagcgcgggtaagaccgcgtggaggaccgaacccacctgggttgaaaaccggggggatgacctggggctaggggtgaaaggccaatcaaattccgtgatagctggttctctccgaaatgcatttaggtgcagcgtcggttgattgcatcgcgggggtagagctactggatgcttgcgggcccgtgtcgggtaccaatagcagccaaactccgaataccgtggatgtgtattccggcagtgagtcggcgggggataagctccgtcgtcgagagggagacagcccagatcgtcgtctaaggtcccgaagcgtgtgctaagtgggaaaggatgtggagtcgcatagacagccaggaggttggctcagaagcagccatccttgaaagagtgcgtaacagctcactggtctagtggttccgcgccgacaatgtagcggggctcaagcacaccaccgaagacgcggcagcggcctttgcggccgttgggtaggagagcgtcccgcgtggggcgaagcggccggggaaccgtgccgtggaccgcgcgggagtgagaatgcagacatgagtagcgagagacgggtgaggatcccgtccgctggatgaccaagggttccggggccacgttcgtcgtccccgggtgagtcgggtcctaaggcgaggccgacaggcgtagtcgaatggatgaacgggtggatattcccgtaccggcggcgtaccgtaagagccgaacggatgagtactaacctccggtcgcgtggcgtcgttcccttcggggttcggggcgcgtggctgttgggagcgtagtcccggtaggctagcgcacaggggtgacacggaatgggagccggccgcggaggtggttttccgtggtcaagcacgcagcccgtcccataggcaaatccgtgggacgcatagggtgaggtgtgatgatgggcgtcctttggacgcgatatccggtggtccaggccgtcgagaaaagcctcggcgcgaggggcgtcgccgcccgtaccccaaaccgacactggtggtcaggtagagaataccaaggcgatcgagcgaatcctggtcaaggaactcggcaaatcactcccgtgccttcggtataagggagacccccgggcgtgaagaggcttgccctcggagcgttggggggtggcacagaccagggggtagcgactgtttaccaaaaacacaggtgcatgcgaaggcgcaagccgctgtatatgcactgacgcctgcccggtgccggaaggttaagaggatccgtcagccccttttggggtgaagcggtgaattcaagccccggtaaacggcggtggtaactataaccatcctaaggtagcgaaattccttgtcgggtaagttccgacctgcacgaatggcgtaacgacttccccactgtctcgaccaggagctcggcgaaattgcagtacgagtaaagatgctcgttaagcgcagaaggacgaaaagaccccgggacctttactataccttggtattggcgttaggcgcggattgtgtagcataggcgggaggcttcgaagcatgggcgccagcccgtgtggagccgcaaggtgaaataccgctctgttctcgtttgacgtctcacctcgaacagtcatcctgttcagggacagtgcctggcgggtagtttaactggggcggttgcctcccaaagagtaacggaggcgctcaaaggtccgctcagcccggttggcaatcgggtttcgagtgtaatcgcacaagcgggcttgactgcgagaacgacggttcgggcagggacgaaagtcggagatagtgatccggtgccggcgcacgggcgcggcatcgctcaacggataaaaggtaccccggggataacaggctgatcattcccaagagtccatatcgacgggatggtttggcacctcgatgtcggctcgtcgcatcctggggctggagcaggtcccaagggttcggctgttcgccgattaaagcggcacgcgagctgggttcagaacgtcgtgagacagtttggtctctatcctctgcgctcgttggaatcctgaggaggcctgcccatagtacgagaggacctgggtggacggacctctggtatgccggttgtcgcgccagcggcatggccggttggctacgttcgggagggataaccgctgaaagcatctaagcgggaagcctgctccaagattaggattccttgacgctccccggagcgtccgaagcccgcatgttgaacacgtgttcgataggccggaggtggaagccccgcgaggggtggagccgaccggtactaacgggcgaacgcggcacactttccgacccgcttgctgggtcgggtctcgtcctgtggtggtttctttcgttggatggcaaggagcattgtttcttgtggtcacgatgacgataccggtgaagcgtttggttgttcgcgtccgttgtccggttcccggaccgccacgaccggaatcggtcgtgtggcgtggttccggttctgccggccgatccttgtggttggccgttatattggttttgcggtggtcatggcccaggtgagacgcccggtccctttccgaacccggaagctaaggcctggtcgcggcgatggtactgcactcgagagggtgtgggagagtagcacgccgccgcattcaac

SEQ ID NO: 89 - DNA, 4557 bp, Bifidobacterium pseudocatenulatum
gcgggcaaccagtcgaactacgccgccgccctggcgatcacgatggccgtgatcacgatggcgatcgcgtacgcggtacagctcaacagcatgaaggagcagatgaagtagcgccttgggccgtgcatcatctgcataagacatggatttttcaaggagcatagcaatcatgagcgatattgcgatgtcgacggggtatatgactccccaagagctcaaagagcaggaacgagccgcaaagaaggctgagagggcacgcttaaagcgcgtggaaatggatgagaaggcggagcgcagacgcgccgcgaaatcaggcttcgcgaatgtggcgaaccctcgcaggagcacgctactgaccatcgtgtgcgcactgttcgcggtgtactgcctgttcccgttcgtgtacctgctgatcaacgccacgaagacgcaggcggacttcacgtccacgttcggtctgggcttcggccgcacgttcgctttgtgggacaacatcaagaccgtgttcacctaccaggacggcatcttcggacgctggttcctgaacacggttctgtacgtggtcgtgggcgccggcggcgcgacattgttggcaatcatgggcggatatgcattggcaaagttccgcttccccggtagaaaagtcgtgttcgcggtcatcatcggcgcgatcagcgtgccgggcatcgccttggctgtgccgcagttcctgctgttcgccaagctgagcctcacgaacacgccgtgggccatgatcattccatcgttgatcagcccgtttggtttgtatctgatgtggatcttctccgagcaggcggttccgacggaattgcttgaagccgcgcgagttgatggagcttcagagttccgcacgttctttcaggtgtccctgccgctgttggctccgggcatcgtgacgacggccctgttcacgatcgtggcgacgtggaacaactacttcctgccgttgatcatgctgaaggattcgaactggtatccgctgacgatcggtctgaaccagtggaaggaccaggcgagcaccgctggcggtcaggcgatccagaacctggtgatcacgggctcgttgatcacgatcgtcccgctggtcatcgcgttcctgtgcctgcaaaagtactggcagtccggtctctcggccggcgccgtcaaagaataacggagccacagtcccaccgactgccccgcaccacgattgttgacgaaaaacggtaatcgaaggcgcattatgtgcataaggaggacagaataaaacaagatgaagaggtgtgtgcatctaatacttgcacacacctcttcatgtattgcggcaaccgagatatgcggatagcatccgagcttcacacagaatcagcctccatgaagcacccctgtatatgcaacatgtctccatcacaagcatttatttctgtttactagatgaagatacaaaagaagcgatgaaactgacgagatttcacatcagaggtatgcctacaatgaagccacaacggaaaaaacggctccgcacgaagcatgaaccaacaaacgaaacgacgagccgcgtgaaaggaagaaaaatgcagaacaataccttcgaccagatcgccagcgccaacaccgtttccatggatgccggcctcagccagttcgccttcgccaaagcctcctccaccttgttcaagaaggttttcagcaagtaagattcctaaaagtctttatcaaacgcctcggctgctgtgatgaaccggttcagcagccgaggcgttctcatatatgctcctgtaacgggcggagacctccccgcccgttacagaccgtccggcggccagtcgaaacaaatcgcggttacgcgccgaccaattcgagcatctgcggaatgctcttcttgccgaactcgacccgctgcgtgccgtcggcccgtgtgatgacgatgcagggcacgctcattgcgccgtattggtccttaagctcaggaaaatgcgaaacgtcgtaggcctcggcgcgcacggcagggtttagcgaggcgaggcgttgggaggcgagcactgtctccgggcacatcgtgcaggtgagcgagacgagaatcatgatattcagcgggcttgcaatggactttgcccgttcgatcagatcatcgcccaacggctgaccaggaccagccacgttgtacaggcccagcacgaacgaattaaattcatgaccggagggcacgccatggaaggcgagaccagtcggctcgccatccaccaccatgcgcacgcatggacgcgctgccggcagcacgtgttccacgtcgaataccgcacgccccgtatcatccttctcgtactcaccatcgaccactaccgatttcagcttgccatcggataacgcgaccatcgcatcgatgaatccccgcagttccgtggacagcggcgtatcgtccagttccaaagcaagcgtgaccgggcgagacatacggttaaagaccacgttgagctgctgtttggtggtgtcggagaacaattcgccgggcttcctaacggcgtttgctgcggcagcggcatcggtgctgcgtttgacgggtgccggtgcgggcgtggtgtcagccaacgaggcggcatctgtcttcgccgtggactgctcgtagacgcaagaggtcgggcgctgtggtatcaaaccggttttctcgctcatccgcttggcgtaccgttccaactccaccgcggcaatagcaccatcggcggtggcagtaaccacttgccgcaggtttttggcccgcagatcaccggccgcatacacgcccggcaccgatgtttcgagatagccgtgcgtgaccacgtaaccataatcgtccagttccaccacgccgcgcaccagattcgtggcgggcacatatcctgcgaacacgaacacgccgaacgtgccaccgtcagcaggtttccacgtttcggtctggccagtggcccggtttaggatcgaagcttcacgtaaaccaccttgcccggcagtgacaccttgcagctcgacctggtaacgcacgtcgatcttcggattgttttttgctgcggcggccaccacagcgtcgcaagtgaagtcctgttcccgtacgagaacggtaactttggaggcgtatgtggtcagaaacacggattcctcggctgctgcgaaccctccgccgaccaccagtacttccttgccggcaaagaactcgccatcgcaggtggcgcagtaggccacaccgcggccagcatattcggactccccttcgaaccctagtttgcgtgggctggcaccggtggcgatgagaataccaaaagctttcaagtcgccgcgcgaagtatgcacggttttgacatcgccatgcacgtcgaggccgatggcttcggcggaaaggaattcagcgccgaaatcctgcgcctgttgacgcatggtctgggtaagcgcacggccagtggtgcggccaacgcccggatagttgaccacctcattggtgatggtgatctgtccgccaaaatcatctttctcgagaatcagtacgcgatatcgggcacgggccaaatacaatcccgccgtcagaccagcgggaccgccgccgatgactatgacatcgtacaaatcatttcgagacataacgactcccttcgtgccttgatctggctattcaggaggtgcccggaggattctcctgggcaccccgtcggattagcttgacaagccgtccgtcaagcgacgatcacagttgaccaacaagatcaaggctaggttcaatagtgtcctcgcctggagtccagttggcagggcaaacctgatcgccatgttcgtggacgaactgagaagcttgcacacggcgtagcagttcttcggcattgcggcccacattggaagagatgacttcataagccacgaccttgccttcggggctcacgatgaagtcaccgcgttcggccatgccatcgacttcgttgtaggtgtcgagatccttggccaatagagcggtcgggtcggcaagcatcggatattgaatcttggcgatcttttcattggcgtcatgccatgccttgtgcacgaagtgggtgtcgcaggagacagagtagacctcgcatccaatttccttgaacttggcgtagttgcgggccagatcctcaagttcagtggggcacacgaaggtgaaatcagccgggtagaagaagaacagggaccagtggccgagcacatcagccttggtcacctcatggaactcgttgttctggaacgcgttcaccttaaaatcggtcagttcatgctgcaggagagtcatcatcggtcctttcgctgattgtcaattatcgggcttctgccgttttccatcgtaacgtgattctctggaacccgcgcggacgtaacgcgtgagcctcatcacatcattactaacagtcacgctgacggaccatgcgatgcaagggtgttgtggattgggagcctcccgcgcgccgcgggaaacacgaaccaaaagacaaaaaaagggttcccggagcgtcacgctcgacgggaaccccgacgttgaatgcggcggcgtgctactctcccacaccctctcga

SEQ ID NO: 90 - DNA, 4275 bp, Bifidobacterium pseudocatenulatum
aacctacagcacaatcccattccacgcaaatcgggcatgacgaaacaagacgcgaacccttgcaaacactggaaagcgtcggcgtgtcgaaatccgtctttcttacaccataaatcgcaaaaccaactccaacacaacccaaaaatcgtcagaaaaagctgattgccgcgtgtcacacaacgcaacaacacggcaatcagcagatcaacagcgcatcacagcaagtcacagacgatcggaaagccaatcgaacaccaaacgcaatgcgcgagcgctacggaatccgtaacaggcatggcaggcgttatcgagcttgtagaacgtcacatccttgccaagcgctttcaacgtggcatacaggcgacaactctgattgaacggcaccaactgatcgcggccaccatgcatgatcagcgttgacggagtgggcatatcggcactcagataagtcataggcgaagccggggcgctcaaatccggatgttcaagcacgtcaccgccatcaatcaccacaccttccgggcactgcggatcactgtggttctgcgaactcggataaaagttcatcttcgcgaaatcagtagggccatgccaatccacgatcgcgttcacttcggtgctttcctcggcataggcatccgtatcaggcgcgcgattgccagtgaacccagccatcaacaccgtatgaccgcccgaagaatcgccccacagcgcaatacgatccttgttgcaatggaagcgttcggcattcttgcgcatgaaacgcaccgcagtcttgcaatcctgcatctgcacggggaacggcgcaatatcgctgtgacgatacttcagcgcagccaccacatacccctgctcggcaatgcgcacgaaataattcgagtaatcggtcacattctgctcgtggaatgccgaaccgcgcacaaacacaatcaccggccaaccaccttccggcatgcgccctcgggcatattgtcaacgccaggcgtgaacacccacatcggcaaatcaacactgctgccatcagccagctgacgggtcacgtatgtaacctgctcgatattcacgggatatccgaaatcatcctggtccaagtcggaaatcacttggcagccttccggaaactcatcagtgtgcgggaagaacttagtctgctcgaccggcgtcggaatcggggcaagccgtgtcggcgacggcggcgccaccatcgattcgatatcgattgccccgatcgccgtaaccgtctcggtcgtttcggcagtctcggccgcatcagcgccatcatctgcaatgttttgtgcaatatcagcagtcataatgcacctctcattcctttccatacatgattattaagattgcttttctcgaatttgattgcccgatgttccctgtttcacgtgaaacatcagaagttacgtcgtgcggctatacctaagatatgagcaaaaagatcgcagtattgacgggggcggggatttccacgtccgcaggtattcccgacttccgtggaccggacggcgtctggactaagcaccctgaacaaacgaaagtgtatgacatcgaagcattcctttgccacgaggaagatcgcaagtattcctggcgttggcagaaggaatcacccgtgtggaccgcacagccgggcaccgcacataaagcgctcgtcaaactggaacaggctggcatgctgacgctgctcgccacacaaaacttcgacgcattgcacgaaaaagcaggcaatagcagcgacgtcatcgtcaatctgcatggcaccatcggtacctcgcactgcatgaagtgccatgcaaaatatgacaccgccgacatcatggcgaatctcgacaacgaacccgatccgcactgccatcgcagactgccctacagcggcaacatgccatgcaacggactcatcaaaaccgacgtggtctacttcggcgaggcgctgccggacggcgcgctcgaaaaatcatatcgactcgcaacgcaggccgacgaactgtgggtcatcggatccacgctggaagtcatgcccgcggcaagcatcgtgcccatagccgcagaggcgggcgtgccgatcaccattatgaacatgggacgcacgcaatacgatcggttggccgaccggcttatccacgacgatatcgccgtcgccctgccgcagctcgtcgacgaaaccatcaccgccgagcagtaagccgcacagtaaatacgttttctcgtacgtcttgcagtaccggcacaaatcgttggaattacaccggttttggttggtcgttaccaaaatccgaatttttcaacgacaaaaatccgaatgacgtaacggctagtcaagcaatataaacaacaaaagggtcttggattgctttgcgacaatcagaaatcatcgcaaggctttccaagacccttattggttatcaaatactgaaaaacggtactgaaatcagtaaatgcgcttcggctggaaaccggcttcccgcaatgcctcgagcacacgatcaatgtggtcgggaccattcgtttcaaccgtcacgcccaaagccacggcattcgcgtaatggctggacgccttgaactggtcgtgatccagcgcgataacgttcgcacgctgctcggccagcaatgtggcgaccttcaccagctgtcccggggtatcgggcagctcgacctcgaaatgcatgatgcggccacgcgtgatcatacccttctgaatcacagcgccaatggacacagtgtcttcattaccgccagacatgatcggcaccaccacatgcggacccttcgcctcagcgaacttgcgcgagcgcaggttgaggtgctcgagcgcagccagagacacagcgccggcagcctcaaccaccagcttgtgcttttcgagcatgagcaggatcatctcgttgatgtcacgctcggtcacggtgacgatgtcgtcaaggaattcgttgagcagcgcgaacgtgagatcgcccggacgcttcacggcgacgccctcggcggacgtgcgcacctggtcggcggcaaccacatgacctgcggccagcgaattcttccatgctgggctaccctccggaatcgcgccgatcacgcgcacttccggcttgaacgtcttgatggcgagcgccacaccggcaccaagaccgccaccgcccagcggcacgaccacgtcggtgacgttcggcacgtcttcgaggatttcaaggccgatggtgccctgaccgcacagcacctcgtaatcgtcgaatggcggcacgtagatcatgccttcggtgtcgctcaattcctgggcgcgggctgcggattcgtcgaacacctcgccgtacagcaccacgtctgcgccgtacgccttggtggcgtcaaccttcagcggcggagtgatctgcggcatgcagatcgttgccttcgcaccacgttcgcgagccgcataggccacgccctgcgcatggttgcccgcggaagcggtgacaatgccgcgagccagctgctcatcactcagggatgcgatcttgttgtaggcgccgcgaatcttgaacgatccggtgacctggagattctcaggcttgagcagaatctcatgtccggtcatgtcggacagcaccttggacggaatgatttccgtgtggcgcgcagtgcccttgagtcgttcggcggctagtttcagttcagctgcgtgatcgcgctgcaatgctttgagaacctcgttttgttccatgagcgttattgtaagcgtacgtctgccgaaactgccttatcatgcggctttcgcgatgaaaagtgagattgcttgcgaaaagtaatcacaagcaatcaggaataatcgcaatacataatctgataaatcacaatacaaataaagaaaaagcgttcgtacgatcccgtgatgaatcgcacgaacgctttttgcagagagtttataggaaagatcgatcagagctggatcacgaccccctcccagcgagcgagctcgccgcgagcgaccgactttacgctatgcacagcatcataggtgctgagcagtacctgcgactcgcccacgccatcctcaagcagttgcgcgacctcagcaggcacctgcgccgtcctatcagtgagattgacgatgacgagaatcgtgtcgtcgccgctggtacgggtgaaggaatacacctgctcgctgtctgccgcgaccagattccattcgcccgtcgcgatggtcgcgttgttgtgacgcatggcgatgagcttcttgtagaagctgtacacggatccgggatcgtcgaattcctcggctgcgttgatctcgac

SEQ ID NO: 91 - DNA, 780 bp, Bifidobacterium pseudocatenulatum
aggaacagcatgattggcacctggacagcggtgaacagcgcgaccctgccgaccgagctccagaactgctggtcgtgaaataggcgaatgtaattgttgattcccacgaactgggtacccccgaccatctgcttctggaagaagctgatgtagatcgcgtacagaatcggaatgatgaacacaaaagtgaacaccaacgcgaacggccacatgaacttccaaccacgccaatccgcccgatgcctgttcacacgcaccgacgaactttttattcccgtaatctgattcacgcttcgctgctttatcatcaatcttcttcctttgttatcgatatctcaatccgagtagttgcatatagttacgtgcgaatcattccggacatcatcggtccggcattaagtattttcttggtatgcgtgtcgtaaaagttgtgtttcacaactggactgttatcgcctcccacggatcaagtacgccatcatgcatagatttgaaagcgtgagctgtcgagtaattggaaagcagtacttgttgtttgttgtcattaattctgagtgattccgatatggttgccttttttgaagacaaattgcagatcaccatgatggttgtatcttccagatgccgttgaaaagcaatgacatcatcgtttcccgcatccattggagaaaaatcgccgacagcgattatcggcatgttgtggcgcatggcgatgagcttcttgtagaagctgtacacggatccgggatcgtcgaattcctcggctgcgttgatctcgac

SEQ ID NO: 92 - DNA, 755 bp, Bifidobacterium pseudocatenulatum
cgcatggcgatgagcttcttgtagaagctgtacacggatccgggatcgtcgaattcctcggctgcgttgatctcgacatgattcggattgacaccgatccacggttccgtcgccgcgtccggcgcggtgaaacctgcatacctggaagcatcccactgcatcggcgtgcgtgcgttgtcgcggccgatgagcgcgagggccgccatcatcgattccggcgactggcatttcgcctcctccacgcgctggcggtaggcgttgatggattccaggtcgcgatactgctcgagcgtggtgaagtgggcgttggtcatgcccagctcttcgccctcgtaaatgtaaggggtgccgcggtgcatgtgcagcagcatgccgaacgccttggcgctcagctcgcgcgactcacggtccgtgtcattgccccaacgggagacgacgcgcggctgatcatggttgcagaagaacaggctggcccagccggcgttcttcacggcctcctgctggtcggcgaggcgggcgcgcagattcttgacttcgaacggcacggtgttccacttggaaccttcctggtcgatgcccacgtggtcgaagaggaacagcatgtcaagttcgccgttcttcggatcggtgacatgctcgttgcgtgccggagtgatgcccggcgcttcgccgacgttcatgtagccttcgcggccttcgaacacttcgcggcgcatttcggcaaggaactcgtcgatgcgcggaccgtcggagca

SEQ ID NO: 93 - DNA, 455 bp, Bifidobacterium pseudocatenulatum
accgcgtacgcgatcgccatcgtgatcacggccatcgtgatcgccagggcggcggcgtagttcgactggttgcccgcgaagctcaggttgtacgcgtacatgttcggcgtgtagtacgtggtgatcgagttgcccggcaccatgttctgcagaatgctcggctcgttgaacagctggaacgagccgatgatcgagaagatcaccgtgatcgcgagcgagcccttcagttcgggcagcttgatggacttgatgatctgccattcgcccgcgccgtcgatcgaggcggcctcgtacagcgaatgcgggatcgtggacagcgagctgtagaagatcagcatgttgtagccggtgaactcccaggtcacgatgttgccgatcgcggcgagcagcacgcttgggctcagcacgtcgaggttcgtgcccagccagtcgttcagggagccgaccagaccgta

SEQ ID NO: 94 - DNA, 405 bp, Bifidobacterium pseudocatenulatum
gtcttcgtggcgttgatcagcaggtacacgaacgggaacaggcagtacaccgcgaacagtgcgcacacgatggtcagcagcgtgctcctgcgcgggttcgccacgttcgcgaagccggacttcgcagccctcttgcgctcggccttctcgtcgcgcgcgaccctcttgaggcgttccttctcggtctttttcgcggccttctcctgggctttgagctcctgagcggtgagcctctgctccgtgcccgcggcgattgttgcgtcactcattttcgatgctccttagcgtttcttcccctatatgcggatggttcgcgccaccgggcgttacttcatctgctccttcatgctgttgagctgcaccgcgtacgcgatcgccatcgtgatcacggccatcgtgatcgcc

SEQ ID NO: 95 - DNA, 343 bp, Bifidobacterium pseudocatenulatum
gtgtgggagagtagcacgccgccgcattcaacgtcggggttcccgtcgagcgtgacgctccgggaacccccttttttgtcttttggtttccgggggatccccgggcgcgacgctccgggaaccccttttcttattcccgcacacgggtgtttcctccattcggtggagggaaacggacgccgggaggcctgccggcgggatgattcctccatcggctggaggtttcgggacgccgggaggcccgtgggcgggcggattcctccagtcactgggagtcccgggacgctgggggatcccaggaattccaggggagcttcctgcccttatccgatggtggaataga

SEQ ID NO: 96 - DNA, 266 bp, Bifidobacterium pseudocatenulatum
atgccgaccctctaaagagattgtgctagcaactcgagataaagaagtgactttctgtaagtgtaagcaaactccagccttactcttagaaacaactgacaatccaatgtgctacttaatcaatctgcaaacagctactgcatggcctctgggggctggatgctaccggaacattagcactgtaggagttcagtcaggctggtgggaaaagtattggttataatagccacaaaccctcttggaaggcctgagagtttgcataactt

SEQ ID NO: 97 - DNA, 233 bp, Bifidobacterium pseudocatenulatum
tcatcaaccccaagacgggtaaacccatggcgacgtgggaggcatacatgaccatcctcaaggtcacgtcgaacaaggacgccaggttcgggtcgtgggacgcggcgcaactgtcgaactttactgacgccgtgaacgcgatgctgcgctggtgtggcgggatgttggggctcccgacccgctacctcggtcaagacaccgtcaatcctgcgtcggagggcgcgatccgcgcc

SEQ ID NO: 98 - DNA, 155 bp, Bifidobacterium pseudocatenulatum
gggggggggggggggggggggggggggggggggggggggggggggggggggggggggggggggggggggggggggggtggggggggggggggggggggggggggggggggggggggggggggggggggggggggggggggggggggggggggggg

SEQ ID NO: 99 - DNA, 78 bp, Bifidobacterium pseudocatenulatum
gggggggggggggggggggggggggggggggggggggggggggggggggggggggggggggggggggggggggggggg
